US011299751B2

(12) United States Patent
Paul et al.

(10) Patent No.: US 11,299,751 B2
(45) Date of Patent: Apr. 12, 2022

(54) COMPOSITIONS FOR THE TREATMENT OF DISEASE

(71) Applicant: VOYAGER THERAPEUTICS, INC., Cambridge, MA (US)

(72) Inventors: Steven Paul, Cambridge, MA (US); Donna T. Ward, Groton, MA (US)

(73) Assignee: Voyager Therapeutics, Inc., Cambridge, MA (US)

(*) Notice: Subject to any disclaimer, the term of this patent is extended or adjusted under 35 U.S.C. 154(b) by 544 days.

(21) Appl. No.: 16/097,446

(22) PCT Filed: Apr. 28, 2017

(86) PCT No.: PCT/US2017/030061
§ 371 (c)(1),
(2) Date: Oct. 29, 2018

(87) PCT Pub. No.: WO2017/189964
PCT Pub. Date: Nov. 2, 2017

(65) Prior Publication Data
US 2020/0165630 A1    May 28, 2020

Related U.S. Application Data

(60) Provisional application No. 62/329,468, filed on Apr. 29, 2016, provisional application No. 62/329,479, filed on Apr. 29, 2016.

(51) Int. Cl.
*C12N 15/86* (2006.01)
*C07K 16/12* (2006.01)
(Continued)

(52) U.S. Cl.
CPC .......... *C12N 15/86* (2013.01); *C07K 16/1282* (2013.01); *C12N 15/113* (2013.01);
(Continued)

(58) Field of Classification Search
None
See application file for complete search history.

(56) References Cited

U.S. PATENT DOCUMENTS 5,064,764 A   11/1991  Besnainon
5,474,935 A   12/1995  Chatterjee
(Continued)

FOREIGN PATENT DOCUMENTS

CN   101186925   5/2008
EP     1015619   7/2000
(Continued)

OTHER PUBLICATIONS

Wu Z, Sun J, Zhang T, Yin C, Yin F, Van Dyke T, Samulski RJ, Monahan PE. Optimization of self-complementary AAV vectors for liver-directed expression results in sustained correction of hemophilia B at low vector dose. Molecular Therapy. Feb. 1, 2008;16(2):280-9. (Year: 2008).*

(Continued)

*Primary Examiner* — Kevin K Hill
*Assistant Examiner* — Anjeanette Roberts
(74) *Attorney, Agent, or Firm* — McCarter & English, LLP; Yu Lu

(57) ABSTRACT

The invention provides compositions and methods for the preparation, manufacture and therapeutic use of viral vectors, such as adeno-associated virus (AAV) particles having viral genomes encoding one or more antibodies or antibody fragments or antibody-like polypeptides, for the prevention and/or treatment of diseases and/or disorders.

20 Claims, 3 Drawing Sheets

Specification includes a Sequence Listing.

(51) Int. Cl.
  *C12N 15/113* (2010.01)
  *A61K 9/00* (2006.01)
  *A61K 38/00* (2006.01)

(52) U.S. Cl.
  CPC ............ *A61K 9/0019* (2013.01); *A61K 38/00* (2013.01); *C07K 2317/14* (2013.01); *C07K 2317/24* (2013.01); *C07K 2317/31* (2013.01); *C07K 2317/76* (2013.01); *C12N 2310/141* (2013.01); *C12N 2750/14143* (2013.01)

(56) References Cited

U.S. PATENT DOCUMENTS

| | | |
|---|---|---|
| 5,587,308 A | 12/1996 | Carter |
| 5,652,224 A | 7/1997 | Wilson |
| 5,658,785 A | 8/1997 | Johnson |
| 5,688,676 A | 11/1997 | Zhou |
| 5,691,176 A | 11/1997 | Lebkowski |
| 5,693,531 A | 12/1997 | Chiorini |
| 5,741,683 A | 4/1998 | Zhou |
| 5,756,283 A | 5/1998 | Wilson |
| 5,856,152 A | 1/1999 | Wilson |
| 5,858,351 A | 1/1999 | Podsakoff |
| 5,858,775 A | 1/1999 | Johnson |
| 5,866,552 A | 2/1999 | Wilson |
| 5,866,696 A | 2/1999 | Carter |
| 5,871,982 A | 2/1999 | Wilson |
| 5,952,221 A | 9/1999 | Kurtzman |
| 5,962,313 A | 10/1999 | Podsakoff |
| 5,989,540 A | 11/1999 | Carter |
| 6,083,716 A | 7/2000 | Wilson |
| 6,143,548 A | 11/2000 | ORiordan |
| 6,143,567 A | 11/2000 | Van Agthoven |
| 6,146,874 A | 11/2000 | Zolotukhin |
| 6,156,303 A | 12/2000 | Russell |
| 6,174,527 B1 | 1/2001 | Wilson |
| 6,180,613 B1 | 1/2001 | Kaplitt |
| 6,194,191 B1 | 2/2001 | Zhang |
| 6,200,560 B1 | 3/2001 | Couto |
| 6,204,059 B1 | 3/2001 | Samulski |
| 6,211,163 B1 | 4/2001 | Podsakoff |
| 6,251,677 B1 | 6/2001 | Wilson |
| 6,258,595 B1 | 7/2001 | Gao |
| 6,261,551 B1 | 7/2001 | Wilson |
| 6,265,389 B1 | 7/2001 | Burke |
| 6,270,996 B1 | 8/2001 | Wilson |
| 6,274,354 B1 | 8/2001 | Wilson |
| 6,281,010 B1 | 8/2001 | Gao |
| 6,325,998 B1 | 12/2001 | Podsakoff |
| 6,335,011 B1 | 1/2002 | Podsakoff |
| 6,365,394 B1 | 4/2002 | Gao |
| 6,387,368 B1 | 5/2002 | Wilson |
| 6,399,385 B1 | 6/2002 | Croyle |
| 6,410,300 B1 | 6/2002 | Samulski |
| 6,416,992 B1 | 7/2002 | Mejza |
| 6,428,988 B1 | 8/2002 | Wilson |
| 6,436,392 B1 | 8/2002 | Engelhardt |
| 6,436,394 B1 | 8/2002 | Henderson |
| 6,468,524 B1 | 10/2002 | Chiorini |
| 6,468,771 B1 | 10/2002 | Einerhand |
| 6,475,769 B1 | 11/2002 | Wilson |
| 6,482,634 B1 | 11/2002 | Wilson |
| 6,485,966 B2 | 11/2002 | Gao |
| 6,503,888 B1 | 1/2003 | Kaplitt |
| 6,509,150 B1 | 1/2003 | Salvetti |
| 6,521,426 B1 | 2/2003 | Ciliberto |
| 6,555,525 B2 | 4/2003 | Burke |
| 6,566,118 B1 | 5/2003 | Atkinson |
| 6,582,692 B1 | 6/2003 | Podsakoff |
| 6,593,123 B1 | 7/2003 | Wright |
| 6,610,290 B2 | 8/2003 | Podsakoff |
| 6,642,051 B1 | 11/2003 | Lynch |
| 6,660,514 B1 | 12/2003 | Zolotukhin |
| 6,660,521 B2 | 12/2003 | Brough |
| 6,670,176 B1 | 12/2003 | Samulski |
| 6,676,935 B2 | 1/2004 | Henderson |
| 6,699,706 B1 | 3/2004 | Brooks |
| 6,710,036 B2 | 3/2004 | Kurtzman |
| 6,723,551 B2 | 4/2004 | Kotin |
| 6,726,907 B1 | 4/2004 | Zhang |
| 6,753,419 B1 | 6/2004 | Toniatti |
| 6,759,237 B1 | 7/2004 | Wilson |
| 6,846,665 B1 | 1/2005 | Horer |
| 6,855,314 B1 | 2/2005 | Chiorini |
| 6,887,463 B2 | 5/2005 | Wilson |
| 6,897,045 B2 | 5/2005 | Engelhardt |
| 6,936,466 B2 | 8/2005 | Feldhaus |
| 6,943,019 B2 | 9/2005 | Wilson |
| 6,953,690 B1 | 10/2005 | Gao |
| 6,984,517 B1 | 1/2006 | Chiorini |
| 6,995,006 B2 | 2/2006 | Atkinson |
| 7,015,026 B2 | 3/2006 | ORiordan |
| 7,022,519 B2 | 4/2006 | Gao |
| 7,048,920 B2 | 5/2006 | Yu |
| 7,056,502 B2 | 6/2006 | Hildinger |
| 7,070,998 B2 | 7/2006 | Johnson |
| 7,091,030 B2 | 8/2006 | Setiawan |
| 7,094,604 B2 | 8/2006 | Snyder |
| 7,105,345 B2 | 9/2006 | Wilson |
| 7,112,321 B2 | 9/2006 | Wang |
| 7,125,705 B2 | 10/2006 | Colosi |
| 7,125,706 B2 | 10/2006 | Zhang |
| 7,169,612 B2 | 1/2007 | Kostenis |
| 7,186,552 B2 | 3/2007 | Wilson |
| 7,198,951 B2 | 4/2007 | Gao |
| 7,223,585 B2 | 5/2007 | Coffey |
| 7,235,393 B2 | 6/2007 | Gao |
| 7,238,526 B2 | 7/2007 | Wilson |
| 7,241,447 B1 | 7/2007 | Engelhardt |
| 7,247,472 B2 | 7/2007 | Wilson |
| 7,271,002 B2 | 9/2007 | Kotin |
| 7,282,199 B2 | 10/2007 | Gao |
| 7,291,498 B2 | 11/2007 | Roy |
| 7,300,797 B2 | 11/2007 | Van Agthoven |
| 7,306,794 B2 | 12/2007 | Wilson |
| 7,319,002 B2 | 1/2008 | Wilson |
| 7,326,555 B2 | 2/2008 | Konz |
| 7,344,872 B2 | 3/2008 | Gao |
| 7,419,817 B2 | 9/2008 | Chiorini |
| 7,419,956 B2 | 9/2008 | Ohtaki |
| 7,445,930 B2 | 11/2008 | Zhang |
| 7,479,554 B2 | 1/2009 | Chiorini |
| 7,491,508 B2 | 2/2009 | Roy |
| 7,510,872 B2 | 3/2009 | Clark |
| 7,510,875 B2 | 3/2009 | Zhang |
| 7,579,181 B2 | 8/2009 | ORiordan |
| 7,625,570 B1 | 12/2009 | Schaffer |
| 7,638,120 B2 | 12/2009 | Liu |
| 7,662,627 B2 | 2/2010 | Johnson |
| 7,704,492 B2 | 4/2010 | Podsakoff |
| 7,704,721 B2 | 4/2010 | Wright |
| 7,732,129 B1 | 6/2010 | Zhang |
| 7,790,449 B2 | 9/2010 | Gao |
| 7,803,622 B2 | 9/2010 | Engelhardt |
| 7,838,277 B2 | 11/2010 | Gao |
| 7,888,096 B2 | 2/2011 | Wu |
| 7,901,921 B2 | 3/2011 | Coffey |
| 7,906,111 B2 | 3/2011 | Wilson |
| 7,968,333 B2 | 6/2011 | Yu |
| 8,105,574 B2 | 1/2012 | Wilson |
| 8,110,351 B2 | 2/2012 | Bosnes |
| 8,137,948 B2 | 3/2012 | Qu |
| 8,163,543 B2 | 4/2012 | Urabe |
| 8,231,880 B2 | 7/2012 | Roy |
| 8,236,495 B2 | 8/2012 | Nochumson |
| 8,241,622 B2 | 8/2012 | Englehardt |
| 8,273,344 B2 | 9/2012 | Wang |
| 8,283,151 B2 | 10/2012 | Schmidt |
| 8,318,480 B2 | 11/2012 | Gao |
| 8,318,687 B2 | 11/2012 | Tabira |
| 8,394,386 B2 | 3/2013 | Wilson |
| 8,409,842 B2 | 4/2013 | Clark |
| 8,470,310 B2 | 6/2013 | Roy |
| 8,476,418 B2 | 7/2013 | Mueller |

(56) References Cited

U.S. PATENT DOCUMENTS

| | | |
|---|---|---|
| 8,512,981 B2 | 8/2013 | Hermens |
| 8,524,219 B2 | 9/2013 | Roy |
| 8,524,446 B2 | 9/2013 | Gao |
| 8,603,459 B2 | 12/2013 | Wilson |
| 8,614,101 B2 | 12/2013 | VanDine |
| 8,637,255 B2 | 1/2014 | Wilson |
| 8,642,314 B2 | 2/2014 | Bakker |
| 8,685,734 B2 | 4/2014 | Coffey |
| 8,697,417 B2 | 4/2014 | Bakker |
| 8,697,665 B2 | 4/2014 | Rom |
| 8,834,863 B2 | 9/2014 | Roy |
| 8,846,030 B2 | 9/2014 | Engelhardt |
| 8,846,389 B2 | 9/2014 | Chiorini |
| 8,865,881 B2 | 10/2014 | Balazs |
| 8,906,387 B2 | 12/2014 | Kay |
| 8,906,675 B2 | 12/2014 | Gao |
| 8,927,514 B2 | 1/2015 | Chatterjee |
| 8,962,330 B2 | 2/2015 | Gao |
| 8,962,332 B2 | 2/2015 | Gao |
| 8,999,678 B2 | 4/2015 | Vandenberghe |
| 9,051,542 B2 | 6/2015 | Wright |
| 9,056,892 B2 | 6/2015 | Pun |
| 9,062,101 B2 | 6/2015 | Barghorn |
| 9,067,996 B2 | 6/2015 | Strakhova |
| 9,080,183 B2 | 7/2015 | Klein |
| 9,089,667 B2 | 7/2015 | Bankiewicz |
| 9,102,722 B2 | 8/2015 | Mueller |
| 9,102,943 B2 | 8/2015 | Shinmura |
| 9,115,373 B2 | 8/2015 | Hermens |
| 9,163,260 B2 | 10/2015 | Wilson |
| 9,217,155 B2 | 12/2015 | Gao |
| 9,217,159 B2 | 12/2015 | Roy |
| 9,228,174 B2 | 1/2016 | Noordman |
| 9,233,174 B2 | 1/2016 | Chen |
| 9,238,800 B2 | 1/2016 | Bossis |
| 9,260,724 B2 | 2/2016 | Bakker |
| 9,303,072 B2 | 4/2016 | Wang |
| 9,394,360 B2 | 7/2016 | Barghorn |
| 9,439,979 B2 | 9/2016 | Chiorini |
| 9,441,038 B2 | 9/2016 | Wu |
| 9,441,206 B2 | 9/2016 | Grieger |
| 9,441,244 B2 | 9/2016 | Schaffer |
| 9,447,179 B2 | 9/2016 | Winderickx |
| 9,447,433 B2 | 9/2016 | Hirsch |
| 9,457,103 B2 | 10/2016 | Schaffer |
| 9,458,517 B2 | 10/2016 | Schaffer |
| 9,464,119 B2 | 10/2016 | Sonntag |
| 9,469,688 B2 | 10/2016 | Benatuil |
| 9,469,689 B2 | 10/2016 | Chen |
| 9,475,845 B2 | 10/2016 | Asokan |
| 9,475,868 B2 | 10/2016 | Woolf |
| 9,481,735 B2 | 11/2016 | Hsieh |
| 9,487,578 B2 | 11/2016 | Gordon |
| 9,487,802 B2 | 11/2016 | Quake |
| 9,493,788 B2 | 11/2016 | Gao |
| 9,506,083 B2 | 11/2016 | Arbetman |
| 9,512,203 B2 | 12/2016 | Baty |
| 9,518,101 B2 | 12/2016 | Novak |
| 9,527,904 B2 | 12/2016 | Balazs |
| 9,528,126 B2 | 12/2016 | Qu |
| 9,540,659 B2 | 1/2017 | Davidson |
| 9,546,112 B2 | 1/2017 | Voit |
| 9,546,369 B2 | 1/2017 | Gao |
| 9,567,376 B2 | 2/2017 | Cronin |
| 9,567,607 B2 | 2/2017 | Wilson |
| 9,580,691 B2 | 2/2017 | Bakker |
| 9,585,971 B2 | 3/2017 | Deverman |
| 9,587,250 B2 | 3/2017 | Gao |
| 9,587,282 B2 | 3/2017 | Schaffer |
| 9,592,284 B2 | 3/2017 | Wilson |
| 9,593,346 B2 | 3/2017 | Roy |
| 9,596,835 B2 | 3/2017 | Gao |
| 9,597,363 B2 | 3/2017 | Roy |
| 9,598,468 B2 | 3/2017 | Weigel-Van Aken |
| 9,598,703 B2 | 3/2017 | Garcia |
| 9,611,302 B2 | 4/2017 | Srivastava |
| 9,617,561 B2 | 4/2017 | Roy |
| 9,623,120 B2 | 4/2017 | Chatterjee |
| 9,624,274 B2 | 4/2017 | Lux |
| 9,636,370 B2 | 5/2017 | McCown |
| 9,658,224 B2 | 5/2017 | Siegel |
| 9,670,507 B2 | 6/2017 | Xiao |
| 9,676,841 B2 | 6/2017 | Chennamsetty |
| 9,677,088 B2 | 6/2017 | Nakai |
| 9,677,089 B2 | 6/2017 | Gao |
| 10,041,090 B2 | 8/2018 | Gao |
| 10,047,155 B2 | 8/2018 | Chen |
| 2001/0006955 A1 | 7/2001 | Wilson |
| 2001/0049144 A1 | 12/2001 | Rivera |
| 2002/0019050 A1 | 2/2002 | Gao |
| 2002/0037867 A1 | 3/2002 | Wilson |
| 2002/0081721 A1 | 6/2002 | Allen |
| 2002/0090717 A1 | 7/2002 | Gao |
| 2002/0102714 A1 | 8/2002 | Wilson |
| 2002/0131961 A1 | 9/2002 | Wilson |
| 2003/0013189 A1 | 1/2003 | Wilson |
| 2003/0032613 A1 | 2/2003 | Gao |
| 2003/0092161 A1 | 5/2003 | Gao |
| 2003/0100115 A1 | 5/2003 | Raj |
| 2003/0119191 A1 | 6/2003 | Gao |
| 2003/0138772 A1 | 7/2003 | Gao |
| 2004/0043490 A1 | 3/2004 | Shimada |
| 2004/0057931 A1 | 3/2004 | Wilson |
| 2004/0136963 A1 | 7/2004 | Wilson |
| 2004/0171807 A1 | 9/2004 | Gao |
| 2005/0261218 A1 | 11/2005 | Esau |
| 2005/0287150 A1 | 12/2005 | Ambrosino et al. |
| 2006/0003451 A1 | 1/2006 | Gao |
| 2006/0204479 A1 | 9/2006 | Wilson |
| 2007/0004042 A1 | 1/2007 | Gao |
| 2008/0008684 A1 | 1/2008 | Wilson |
| 2008/0050343 A1 | 2/2008 | Wilson |
| 2008/0050345 A1 | 2/2008 | Wilson |
| 2008/0075737 A1 | 3/2008 | Gao |
| 2009/0022736 A1* | 1/2009 | Reason .................. C40B 30/04 424/164.1 |
| 2009/0215871 A1 | 8/2009 | Wilson |
| 2009/0275107 A1 | 11/2009 | Lock |
| 2009/0317417 A1 | 12/2009 | Vandenberghe |
| 2010/0035973 A1 | 2/2010 | Walker |
| 2010/0233182 A1* | 9/2010 | Ambrosino ............... A61P 1/12 424/150.1 |
| 2010/0247490 A1 | 9/2010 | Roy |
| 2010/0278791 A1 | 11/2010 | Wilson |
| 2011/0071214 A1 | 3/2011 | Allen |
| 2011/0136227 A1 | 6/2011 | Bakker |
| 2011/0171262 A1 | 7/2011 | Bakker |
| 2011/0223135 A1 | 9/2011 | Roy |
| 2011/0229971 A1 | 9/2011 | Knop |
| 2011/0274691 A1 | 11/2011 | Arvedson |
| 2012/0046349 A1 | 2/2012 | Bell |
| 2012/0058102 A1 | 3/2012 | Wilson |
| 2012/0093853 A1 | 4/2012 | Wilson |
| 2012/0137379 A1 | 5/2012 | Gao |
| 2012/0258046 A1 | 10/2012 | Mutzke |
| 2013/0023033 A1 | 1/2013 | Wilson |
| 2013/0045186 A1 | 2/2013 | Gao |
| 2013/0058962 A1 | 3/2013 | Shoemaker et al. |
| 2013/0101558 A1 | 4/2013 | Gao |
| 2013/0195801 A1 | 8/2013 | Gao |
| 2013/0202618 A1 | 8/2013 | Ma et al. |
| 2013/0230531 A1* | 9/2013 | Gurnett-Bander ........ A61P 1/00 424/139.1 |
| 2013/0296532 A1 | 11/2013 | Hermens |
| 2013/0323226 A1 | 12/2013 | Wilson |
| 2013/0323302 A1 | 12/2013 | Constable |
| 2014/0031418 A1 | 1/2014 | Wilson |
| 2014/0044680 A1 | 2/2014 | Roy |
| 2014/0044794 A1 | 2/2014 | Okada |
| 2014/0065105 A1 | 3/2014 | Wilson |
| 2014/0087361 A1 | 3/2014 | Dobbelaer |
| 2014/0099666 A1 | 4/2014 | Rossomando |
| 2014/0107186 A1 | 4/2014 | Garcia |
| 2014/0336245 A1 | 11/2014 | Mingozzi |

(56) References Cited

U.S. PATENT DOCUMENTS

| | | |
|---|---|---|
| 2014/0341852 A1 | 11/2014 | Srivastava |
| 2014/0342434 A1 | 11/2014 | Hermens |
| 2015/0005369 A1 | 1/2015 | Muzyczka |
| 2015/0010578 A1 | 1/2015 | Balazs |
| 2015/0023924 A1 | 1/2015 | High |
| 2015/0065562 A1 | 3/2015 | Yazicioglu |
| 2015/0118287 A1 | 4/2015 | Hammond |
| 2015/0139952 A1 | 5/2015 | Webster |
| 2015/0159173 A1 | 6/2015 | Vandenberghe |
| 2015/0166610 A1 | 6/2015 | Baudoux |
| 2015/0182638 A1 | 7/2015 | Crystal |
| 2015/0190501 A1 | 7/2015 | Weber |
| 2015/0203585 A1 | 7/2015 | Mi |
| 2015/0210771 A1 | 7/2015 | Crystal |
| 2015/0218261 A1 | 8/2015 | Barghorn |
| 2015/0230430 A1 | 8/2015 | Wilson |
| 2015/0232533 A1 | 8/2015 | Chen |
| 2015/0238610 A1 | 8/2015 | Sista |
| 2015/0307898 A2 | 10/2015 | Hermens |
| 2015/0315610 A1 | 11/2015 | Nishie |
| 2015/0374803 A1 | 12/2015 | Wolfe |
| 2016/0032319 A1 | 2/2016 | Wright |
| 2016/0102323 A1 | 4/2016 | Cellectis et al. |
| 2016/0108373 A1 | 4/2016 | Bennett |
| 2016/0153992 A1 | 6/2016 | Buening |
| 2016/0264649 A1 | 9/2016 | Chan-Hui |
| 2016/0264680 A1 | 9/2016 | Poul |
| 2016/0271192 A1 | 9/2016 | Roy |
| 2016/0272703 A1 | 9/2016 | Hsieh |
| 2016/0273058 A1 | 9/2016 | Akashika |
| 2016/0280791 A1 | 9/2016 | Ghayur |
| 2016/0289275 A1 | 10/2016 | Chiorini |
| 2016/0289278 A1 | 10/2016 | Bakaletz |
| 2016/0296638 A1 | 10/2016 | Crystal |
| 2016/0296694 A1 | 10/2016 | Bankiewicz |
| 2016/0297885 A1 | 10/2016 | Kuo |
| 2016/0304591 A1 | 10/2016 | Kelley |
| 2016/0317677 A1 | 11/2016 | Bhatia |
| 2016/0319000 A1 | 11/2016 | Woolf |
| 2016/0319033 A1 | 11/2016 | Chardes |
| 2016/0326238 A1 | 11/2016 | Barghorn |
| 2016/0331897 A1 | 11/2016 | Anand |
| 2016/0333372 A1 | 11/2016 | Srivastava |
| 2016/0333373 A1 | 11/2016 | Farley |
| 2016/0333375 A1 | 11/2016 | Chen |
| 2016/0339090 A1 | 11/2016 | Hacohen |
| 2016/0340393 A1 | 11/2016 | Schaffer |
| 2016/0340418 A1 | 11/2016 | Baron |
| 2016/0340692 A1 | 11/2016 | Wang |
| 2016/0347850 A1 | 12/2016 | Benatuil |
| 2016/0354465 A1 | 12/2016 | Mi |
| 2016/0355573 A1 | 12/2016 | Crystal |
| 2016/0355577 A1 | 12/2016 | Kelley |
| 2016/0355583 A1 | 12/2016 | Chen |
| 2016/0361439 A1 | 12/2016 | Agbandje-McKenna |
| 2016/0369298 A1 | 12/2016 | Marsic |
| 2016/0369299 A1 | 12/2016 | Boye |
| 2016/0375151 A1 | 12/2016 | Schaffer |
| 2016/0376323 A1 | 12/2016 | Schaffer |
| 2016/0376608 A1 | 12/2016 | Chou |
| 2017/0000904 A1 | 1/2017 | Wilson |
| 2017/0002075 A1 | 1/2017 | Gu |
| 2017/0007669 A1 | 1/2017 | Sarkar |
| 2017/0007679 A1 | 1/2017 | Maeder |
| 2017/0007720 A1 | 1/2017 | Boye |
| 2017/0008964 A1 | 1/2017 | Batt |
| 2017/0015742 A1 | 1/2017 | Gu |
| 2017/0022269 A1 | 1/2017 | Barghorn |
| 2017/0022281 A1 | 1/2017 | Anderson |
| 2017/0022292 A1 | 1/2017 | Eder |
| 2017/0028082 A1 | 2/2017 | Wilson |
| 2017/0035905 A1 | 2/2017 | Abrams |
| 2017/0043035 A1 | 2/2017 | Wilson |
| 2017/0044504 A1 | 2/2017 | Schaffer |
| 2017/0049909 A1 | 2/2017 | Cullen |
| 2017/0067028 A1 | 3/2017 | Ballon |
| 2017/0071972 A1 | 3/2017 | Buj Bello |
| 2017/0073685 A1 | 3/2017 | Maeder |
| 2017/0073703 A1 | 3/2017 | Chatterjee |
| 2017/0088605 A1 | 3/2017 | Abend |
| 2017/0088625 A1 | 3/2017 | Tedder |
| 2017/0088631 A1 | 3/2017 | Ast |
| 2017/0088858 A1 | 3/2017 | Gao |
| 2017/0096470 A1 | 4/2017 | Ghayur |
| 2017/0096646 A1 | 4/2017 | Roy |
| 2017/0105927 A1 | 4/2017 | Thorne |
| 2017/0106095 A1 | 4/2017 | Batt |
| 2017/0112878 A1 | 4/2017 | Kaufmann |
| 2017/0112946 A1 | 4/2017 | Ikeda |
| 2017/0114130 A1 | 4/2017 | Rondon |
| 2017/0114364 A9 | 4/2017 | Allison |
| 2017/0121734 A1 | 5/2017 | Cairns |
| 2017/0128594 A1 | 5/2017 | Wright |
| 2017/0130208 A1 | 5/2017 | Potter |
| 2017/0130245 A1 | 5/2017 | Kotin |
| 2017/0137532 A1 | 5/2017 | Liu |
| 2017/0145440 A1 | 5/2017 | Hermens |
| 2017/0151345 A1 | 6/2017 | Shah |
| 2017/0151348 A1 | 6/2017 | Kaspar |
| 2017/0151416 A1 | 6/2017 | Kutikov |
| 2017/0152324 A1 | 6/2017 | Baty |
| 2017/0152525 A1 | 6/2017 | Hermens |
| 2017/0157212 A1 | 6/2017 | Jones |
| 2017/0157267 A1 | 6/2017 | Kay |
| 2017/0159026 A1 | 6/2017 | Kay |
| 2017/0159027 A1 | 6/2017 | Wilson |
| 2017/0159072 A9 | 6/2017 | Arbeit |
| 2017/0165377 A1 | 6/2017 | Gao |
| 2017/0166625 A1 | 6/2017 | Di Clemente |
| 2017/0166871 A1 | 6/2017 | Nishie |
| 2017/0166923 A1 | 6/2017 | Goepfert |
| 2017/0166925 A1 | 6/2017 | Gao |
| 2017/0166926 A1 | 6/2017 | Deverman |
| 2017/0166927 A1 | 6/2017 | Gao |
| 2018/0222967 A1 | 8/2018 | Li |
| 2018/0235887 A1 | 8/2018 | Garidel |
| 2018/0237511 A1 | 8/2018 | Beil |
| 2018/0243411 A1 | 8/2018 | June |
| 2018/0243416 A1 | 8/2018 | Limberis |
| 2018/0244746 A1 | 8/2018 | Mallone |
| 2020/0023076 A1* | 1/2020 | Fotin-Mleczek .. C07K 16/1027 |

FOREIGN PATENT DOCUMENTS

| | | | |
|---|---|---|---|
| EP | 1046711 | 10/2000 | |
| EP | 1078096 | 2/2001 | |
| EP | 1164195 | 12/2001 | |
| EP | 1183380 | 3/2002 | |
| EP | 1218035 | 7/2002 | |
| EP | 1240345 | 9/2002 | |
| EP | 1279740 | 1/2003 | |
| EP | 1453547 | 9/2004 | |
| EP | 1578253 | 9/2005 | |
| EP | 1696036 | 8/2006 | |
| EP | 1847614 | 10/2007 | |
| EP | 1849872 | 10/2007 | |
| EP | 1857552 | 11/2007 | |
| EP | 1944043 | 7/2008 | |
| EP | 2007795 | 12/2008 | |
| EP | 2188310 | 5/2010 | |
| EP | 2198016 | 6/2010 | |
| EP | 2217697 | 8/2010 | |
| EP | 2220241 | 8/2010 | |
| EP | 2220242 | 8/2010 | |
| EP | 2278020 A2 * | 1/2011 | ............. A61P 35/04 |
| EP | 2287191 | 2/2011 | |
| EP | 2292779 | 3/2011 | |
| EP | 2325298 | 5/2011 | |
| EP | 2359866 | 8/2011 | |
| EP | 2383346 | 11/2011 | |
| EP | 2524037 | 11/2012 | |
| EP | 2531604 | 12/2012 | |
| EP | 2660325 | 11/2013 | |
| EP | 2678433 | 1/2014 | |

(56) References Cited

FOREIGN PATENT DOCUMENTS

| | | |
|---|---|---|
| EP | 2737071 | 6/2014 |
| EP | 2814958 | 12/2014 |
| EP | 2851374 | 3/2015 |
| EP | 2871239 | 5/2015 |
| EP | 2879719 | 6/2015 |
| EP | 2933336 | 10/2015 |
| EP | 2975053 | 1/2016 |
| EP | 3058959 | 8/2016 |
| EP | 3067417 | 9/2016 |
| EP | 3068801 | 9/2016 |
| EP | 3077408 | 10/2016 |
| EP | 3083696 | 10/2016 |
| EP | 2176283 | 11/2016 |
| EP | 3091033 | 11/2016 |
| EP | 3108000 | 12/2016 |
| EP | 3112380 | 1/2017 |
| EP | 3117005 | 1/2017 |
| EP | 3126386 | 2/2017 |
| EP | 3134431 | 3/2017 |
| EP | 3149038 | 4/2017 |
| EP | 3149039 | 4/2017 |
| EP | 3160990 | 5/2017 |
| EP | 3160991 | 5/2017 |
| EP | 3168298 | 5/2017 |
| EP | 3177643 | 6/2017 |
| EP | 3356405 | 8/2018 |
| EP | 3360570 | 8/2018 |
| EP | 3362472 | 8/2018 |
| EP | 3363816 | 8/2018 |
| EP | 3363817 | 8/2018 |
| EP | 3365364 | 8/2018 |
| EP | 3365369 | 8/2018 |
| WO | 1990007936 | 7/1990 |
| WO | 1993009239 | 5/1993 |
| WO | 1995034670 | 12/1995 |
| WO | 1996017947 | 6/1996 |
| WO | 1996023810 | 8/1996 |
| WO | 1996030540 | 10/1996 |
| WO | 1998010088 | 3/1998 |
| WO | 1999027110 | 6/1999 |
| WO | 1999043360 | 9/1999 |
| WO | 1999058700 | 11/1999 |
| WO | 1999061595 | 12/1999 |
| WO | 1999060146 | 5/2000 |
| WO | 2000024916 | 5/2000 |
| WO | 2000028061 | 5/2000 |
| WO | 2000066780 | 11/2000 |
| WO | 2000075353 | 12/2000 |
| WO | 2001014539 | 3/2001 |
| WO | 2001023001 | 4/2001 |
| WO | 2001025465 | 4/2001 |
| WO | 2001032711 | 5/2001 |
| WO | 2001036623 | 5/2001 |
| WO | 2001042444 | 6/2001 |
| WO | 2001068888 | 9/2001 |
| WO | 2001096587 | 12/2001 |
| WO | 2002012525 | 2/2002 |
| WO | 2002014487 | 2/2002 |
| WO | 2002020748 | 3/2002 |
| WO | 2002070719 | 9/2002 |
| WO | 2002071843 | 9/2002 |
| WO | 2003010320 | 2/2003 |
| WO | 2003024502 | 3/2003 |
| WO | 2003042397 | 5/2003 |
| WO | 2003087382 | 10/2003 |
| WO | 2003087383 | 10/2003 |
| WO | 2004044003 | 5/2004 |
| WO | 2004083441 | 9/2004 |
| WO | 2004108922 | 12/2004 |
| WO | 2004111248 | 12/2004 |
| WO | 2005005610 | 1/2005 |
| WO | 2005012537 | 2/2005 |
| WO | 2005111220 | 11/2005 |
| WO | 2006102072 | 9/2006 |
| WO | 2007130519 | 11/2007 |
| WO | 2007148971 | 7/2009 |
| WO | 2009134681 | 11/2009 |
| WO | 2011038187 | 3/2011 |
| WO | 2011054976 | 5/2011 |
| WO | 2011122950 | 10/2011 |
| WO | 2010109053 | 11/2011 |
| WO | 2012057363 | 5/2012 |
| WO | 2012114090 | 8/2012 |
| WO | 2012144446 | 10/2012 |
| WO | 2013078199 | 5/2013 |
| WO | 2013164793 | 11/2013 |
| WO | 2013170078 | 11/2013 |
| WO | 2014016737 | 1/2014 |
| WO | 2014160092 | 10/2014 |
| WO | 2014168953 | 10/2014 |
| WO | 2014170470 | 10/2014 |
| WO | 2014170480 | 10/2014 |
| WO | 2014172669 | 10/2014 |
| WO | 2014186579 | 11/2014 |
| WO | 2014194132 | 12/2014 |
| WO | 2014201252 | 12/2014 |
| WO | 2015012924 | 1/2015 |
| WO | 2015018503 | 2/2015 |
| WO | 2014186746 | 3/2015 |
| WO | 2015035190 | 3/2015 |
| WO | 2015035190 A1 | 3/2015 |
| WO | 2015031686 | 4/2015 |
| WO | 2015044292 | 4/2015 |
| WO | 2015060722 | 4/2015 |
| WO | 2015080973 | 6/2015 |
| WO | 2015108610 | 7/2015 |
| WO | 2015114365 | 8/2015 |
| WO | 2015121501 | 8/2015 |
| WO | 2015124546 | 8/2015 |
| WO | 2015137802 | 9/2015 |
| WO | 2015/175639 A1 | 11/2015 |
| WO | 2015127128 | 11/2015 |
| WO | 2015175639 | 11/2015 |
| WO | 2015191508 | 12/2015 |
| WO | 2015191508 A1 | 12/2015 |
| WO | 2015196179 | 12/2015 |
| WO | 2016007741 | 1/2016 |
| WO | 2016014688 | 1/2016 |
| WO | 2016019364 | 2/2016 |
| WO | 2016019364 A1 | 2/2016 |
| WO | 2016028682 | 2/2016 |
| WO | 2016028682 A1 | 2/2016 |
| WO | 2016054554 | 4/2016 |
| WO | 2016054557 | 4/2016 |
| WO | 2016065001 | 4/2016 |
| WO | 2016081811 | 5/2016 |
| WO | 2016081927 | 5/2016 |
| WO | 2016115382 | 7/2016 |
| WO | 2016122791 | 8/2016 |
| WO | 2016126857 | 8/2016 |
| WO | 2016130591 | 8/2016 |
| WO | 2016137949 | 9/2016 |
| WO | 2016141244 | 9/2016 |
| WO | 2016141245 | 9/2016 |
| WO | 2016149695 | 9/2016 |
| WO | 2016149698 | 9/2016 |
| WO | 2016149710 | 9/2016 |
| WO | 2016154055 | 9/2016 |
| WO | 2016154344 | 9/2016 |
| WO | 2016156291 | 10/2016 |
| WO | 2016160976 | 10/2016 |
| WO | 2016164609 | 10/2016 |
| WO | 2016168728 | 10/2016 |
| WO | 2016172008 | 10/2016 |
| WO | 2016172155 | 10/2016 |
| WO | 2016179496 | 11/2016 |
| WO | 2016183236 | 11/2016 |
| WO | 2016183297 | 11/2016 |
| WO | 2016187068 | 11/2016 |
| WO | 2016188911 | 12/2016 |
| WO | 2016191418 | 12/2016 |
| WO | 2016196507 | 12/2016 |
| WO | 2016196975 | 12/2016 |
| WO | 2016197367 | 12/2016 |

(56) References Cited

FOREIGN PATENT DOCUMENTS

| | | |
|---|---|---|
| WO | 2016198500 | 12/2016 |
| WO | 2016200543 | 12/2016 |
| WO | 2016203432 | 12/2016 |
| WO | 2017004514 | 1/2017 |
| WO | 2017005806 | 1/2017 |
| WO | 2017005923 | 1/2017 |
| WO | 2017011342 | 1/2017 |
| WO | 2017011413 | 1/2017 |
| WO | 2017011414 | 1/2017 |
| WO | 2017015102 | 1/2017 |
| WO | 2017015619 | 1/2017 |
| WO | 2017019876 | 2/2017 |
| WO | 2017019994 | 2/2017 |
| WO | 2017020858 | 2/2017 |
| WO | 2017021893 | 2/2017 |
| WO | 2017023863 | 2/2017 |
| WO | 2017024515 | 2/2017 |
| WO | 2017027805 | 2/2017 |
| WO | 2017040312 | 3/2017 |
| WO | 2017040528 | 3/2017 |
| WO | 2017042701 | 3/2017 |
| WO | 2017049266 | 3/2017 |
| WO | 2017053170 | 3/2017 |
| WO | 2017058892 | 4/2017 |
| WO | 2017070284 | 4/2017 |
| WO | 2017070476 | 4/2017 |
| WO | 2017070516 | 4/2017 |
| WO | 2017070525 | 4/2017 |
| WO | 2017070678 | 4/2017 |
| WO | 2017072150 | 5/2017 |
| WO | 2017074878 | 5/2017 |
| WO | 2017075335 | 5/2017 |
| WO | 2017075338 | 5/2017 |
| WO | 2017075338 A2 | 5/2017 |
| WO | 2017075475 | 5/2017 |
| WO | 2017079479 | 5/2017 |
| WO | 2017083423 | 5/2017 |
| WO | 2017091512 | 6/2017 |
| WO | 2017093330 | 6/2017 |
| WO | 2017095823 | 6/2017 |
| WO | 2017096039 | 6/2017 |
| WO | 2017100671 | 6/2017 |
| WO | 2017100674 | 6/2017 |
| WO | 2017100676 | 6/2017 |
| WO | 2017100704 | 6/2017 |
| WO | 2018144535 | 8/2018 |
| WO | 2018146230 | 8/2018 |
| WO | 2018146594 | 8/2018 |
| WO | 2018148454 | 8/2018 |
| WO | 2018152435 | 8/2018 |

OTHER PUBLICATIONS

Holland, Julia. Doctoral dissertation, Development of a highly potent bispecific antibody format targeting the novel tumor-specific antigen CLDN18.2; Johannes Gutenberg-Universität Mainz; online publ. Jan. 8, 2015 (Year: 2015).*
Robert MA, Gilbert R, Gaillet B. Antibody Delivery Mediated by Recombinant Adeno-associated Virus for the Treatment of Various Chronic and Infectious Diseases. Current Gene Therapy. Dec. 1, 2016;16(6):363-74. Cited in IDS Filed Feb. 4, 2019 (Year: 2016).*
Klein JS, Jiang S, Galimidi RP, Keeffe JR, Bjorkman PJ. Design and characterization of structured protein linkers with differing flexibilities. Protein Eng Des Sel. 2014;27(10):325-330. doi:10.1093/protein/gzu043 (Year: 2014).*
De Bishnu P, Hackett NR, Crystal RG, Boyer JL. Rapid/sustained anti-anthrax passive immunity mediated by co-administration of Ad/AAV. Molecular Therapy. Jan. 1, 2008;16(1):203-9. (Year: 2008).*
Fotin-Mleczek, PCT/EP2016/059711 priority document edited due to size: pp. 1-4, 507-8, 1207-8. Retrieved Nov. 10, 2021 (Year: 2016).*
PatentScope index of files. Sequence Listing filed Feb. 11, 2017; retrieved Nov. 10, 2921. (Year: 2017).*

"Human anti-C. difficile toxin A/B antibody-related protein, SEQ: 370.", XP002796058, retrieved from EBI accession No. GSP:BAT18050 Database accession No. BAT18050 * sequence * Nov. 7, 2013 (Nov. 7, 2013).
Extended European Search Report dated Apr. 29, 2020 in corresponding Europe application No. 17790509.8, entitled Compositions for the Treatment of Disease.
Saunders, K.O. et al., "Broadly neutralizing human immunodeficiency virus type 1 antibody gene transfer protects nonhuman primates from mucosal simian-human immunodeficiency virus infection" (2015) Journal of virology 89 (16):8334-8345.
Liao F, et al. Targeting of nonlipidated, aggregated apoE with antibodies inhibits amyloid accumulation. J Clin Invest. May 1, 2018;128(5):2144-2155.
Badamchi-Zadeh A, et al. Therapeutic Efficacy of Vectored PGT121 Gene Delivery in HIV-1-Infected Humanized Mice. J. Virol.
Tse LV, et al. Mapping and engineering function domains of the assembly-activating protein of adeno-associated viruses. J. Virol. Jun. 29, 2018;92(14).
Hay CE, et al. Development and testing of AAV-delivered single-chain variable fragments for the treatment of methamphetamine abuse. PLoS One. Jun. 29, 2018;13(6):e0200060.
Rincon MY, et al. Widespread transduction of astrocytes and neurons in the mouse central nervous system after systemic delivery of a self-complementary AAV-PHP.B vector. Gene Ther. Apr. 2018;25(2):83-92.
Liu YY, et al. AAV8-antiVEGFfab Ocular Gene Transfer for Neovascular Age-Related Macular Degeneration. Mol Ther. Feb. 7, 2018;26(2):542-549.
Chatterjee D, et al. Proteasome-targeted nanobodies alleviate pathology and functional decline in an α-synuclein-based Parkinson's disease model. NPJ Parkinsons Dis. Aug. 22, 2018;4:25.
Rothwell et al. Intrathecal viral vector delivery of trastuzumab prevents or inhibits tumor growth of human HER2-positive xenografts in mice. Cancer Res. Aug. 28, 2018 Epub ahead of print.
Hay BA, et al. Vectored gene delivery for lifetime animal contraception: Overview and hurdles to implementation. Theriogenology. May 2018;112:63-74.
Gowanlock D, et al. A designer AAV variant permits efficient retrograde access to projection neurons. Neuron. Oct. 19, 2016;92(2):372-382.
Maier M et al. A human-derived antibody targets misfolded SOD1 and ameliorates motor symptoms in mouse models of amyotrophic lateral sclerosis. Science Trans Med. Dec. 5, 2018 10(470).
International Search Report issued in corresponding PCT Application No. PCT/US2017/030061 dated Oct. 20, 2017.
Deal CE, et al. Vectored antibody gene delivery for the prevention or treatment of HIV infection. Curr Opin HIV AIDS. May 2015;10(3):190-7.
Achour I, et al. Tetrameric and homodimeric camelid IgGs originate from the same IgH locus. J Immunol. Aug. 1, 2008;181(3):2001-9.
Vitale F, et al. Anti-tau conformational scFv MC1 antibody efficiently reduces pathological tau species in adult JNPL3 mice. Acta Neuropathol. Commun. Aug. 22, 2018;6(1):82.
De Leeuw CN et al. rAAV-compatible MiniPromoters for Restricted Expression in the Brain and Eye. Mol Brain. May 10, 2016;9(1):52.
Hirsch ML, et al. Delivering Transgenic DNA Exceeding the Carrying Capacity of AAV Vectors. Methods Mol Biol. 2016;1382:21-39.
Lu J, et al. A 5'non-coding exon containing engineered intron enhances transgene expression from recombinant AAV vectors in vivo. Hum Gene Ther. Jan. 2017;28(1):125-134.
Powell SK, et al. Viral expression cassette elements to enhance transgene target specificity and expression in gene therapy. Discov Med. Jan. 2015;19(102):49-57.
Rosario AM et al. Microglia-specific Targeting by Novel Capsid-modified AAV6 Vectors. Mol Ther Methods Clin Dev. Apr. 13, 2016;3:16026.
Wang L, et al. Productive life cycle of adeno-associated virus serotype 2 in the complete absence of a conventional polyadenylation signal. J Gen Virol. Sep. 2015;96(9):2780-7.

(56) References Cited

OTHER PUBLICATIONS

Yan ZY, et al. Optimization of recombinant adeno-associated virus mediated expression for large transgenes, using a synthetic promoter and tandem array enhancers. Hum Gene Ther. Jun. 2015;26(6):334-46.
Jackson KL, et al. Better Targeting, Better Efficiency for Wide-Scale Neuronal Transduction with the Synapsin Promoter and AAV-PHP. B. Front Mol Neurosci. Nov. 2016;6:116.
Mcclements ME, et al. A fragmented adeno-associated viral dual vector strategy for treatment of diseases caused by mutations in large genes leads to expression of hybrid transcripts. J Genet Syndr Gene Ther. Nov. 2016;7(5):311.
Parr MJ, et al. Tumor-selective transgene expression in vivo mediated by an E2F-responsive adenoviral vector. Nat Med. Oct. 1997;3(10):1145-9.
Reid CA, et al. miRNA mediated post-transcriptional silencing of transgenes leads to increased adeno-associated viral vector yield and targeting specificity. Gene Ther. Jun. 15, 2017. Epub ahead of print.
Sawada Y et al. Inflammation-induced Reversible Switch of the Neuron-specific Enolase Promoter from Purkinje Neurons to Bergmann Glia. Sci Rep. Jun. 13, 2016;6:27758.
Lukashcuk V et al. AAV9-mediated central nervous system-targeted gene delivery via cisterna magna route in mice. Mol Ther Methods Clin Dev. Feb. 17, 2016;3:15055.
Tarantal AF, et al. Systemic and Persistent Muscle Gene Expression in Rhesus Monkeys with a Liver De-targeted Adeno-Associated Virus (AAV) Vector. Hum Gene Ther. May 2017;28(5):385-391.
Huang LY, et al. Characterization of the Adeno-Associated Virus 1 and 6 Sialic Acid Binding Site. J Virol. May 12, 2016;90(11):5219-30.
Siu JJ, et al. Improved gene delivery to adult mouse spinal cord through the use of engineered hybrid adeno-associated viral serotypes. Gene Ther. Apr. 25, 2017. Epub ahead of print.
Deng XF, et al. Replication of an autonomous human parvovirus in non-dividing human airway epithelium is facilitated through the DNA damage and repair pathways. PLoS Pathog. Jan. 2016;12(1):e1005399.
Kailasan S, et al. Structure of an Enteric Pathogen, Bovine Parvovirus.J Virol. Mar. 2015, 89(5):2603-14.
Alton EW, et al. Repeated nebulisation of non-viral CFTR gene therapy in patients with cystic fibrosis: a randomised, double-blind, placebo-controlled, phase 2b trial. Lancet Respir Med. Sep. 2015;3(9):684-91.
Baum BJ, et al. Early responses to adenoviral-mediated transfer of the aquaporin-1 cDNA for radiation-induced salivary hypofunction. Proc Natl Acad Sci U S A. Nov. 20, 2012;109(47):19403-7.
Shen W, et al. Analysis of the Cis and Trans Requirements for DNA Replication at the Right End Hairpin of the Human Bocavirus 1 Genome. J Virol. Aug. 2016;90(17):7761-77.
Lee SH et al. Antibody-Mediated Targeting of Tau In Vivo Does Not Require Effector Function and Microglial Engagement. Cell Rep. Aug. 9, 2016;16(6):1690-700.
Liu W, et al. Vectored Intracerebral Immunization with the Anti-Tau Monoclonal Antibody PHF1 Markedly Reduces Tau Pathology in Mutant Tau Transgenic Mice. J Neurosci. Dec. 2016;36(49):12425-12535.
Levites Y, et al. A Human Monoclonal IgG That Binds a Beta Assemblies and Diverse Amyloids Exhibits Anti-Amyloid Activities In Vitro and In Vivo. J Neurosci. Apr. 2015, 35(16):6265-76.
Kou JH, et al. Catalytic Immunoglobulin Gene Delivery in a Mouse Model of Alzheimer's Disease: Prophylactic and Therapeutic Applications. Mol Neurobiol. Feb. 2015,51(1):43-56.
Picher-Martel V et al. From Animal Models to Human Disease: A Genetic Approach for Personalized Medicine in ALS. Acta Neuropathol Commun. Jul. 11, 2016;4(1):70.
Pagovich OE, et al. Anti-hIgE gene therapy of peanut-induced anaphylaxis in a humanized murine model of peanut allergy. J Allergy Clin Immunol. Dec. 2016;138(6):1652-1662.

Sing C, et al. AAV-mediated expression of anti-tau scFvs decreases tau accumulation in a mouse model of tauopathy. J Exp Med. Apr. 17, 2017. Epub ahead of print.
Verhelle A, et al. AAV9 delivered bispecific nanobody attenuates amyloid burden in the gelsolin amyloidosis mouse model. Hum Mol Genet. Apr. 2017;26(7):1353-1364.
Hicks MJ, et al. Genetic modification of neurons to express bevacizumab for local anti-angiogenesis treatment of glioblastoma. Cancer Gene Ther. Jan. 2015, 22(1):1-8.
Brady JM, et al. Antibody gene transfer with adeno-associated viral vectors as a method for HIV prevention. Immunol Rev. Jan. 2017;275(1):324-333.
Fuchs SP, et al. AAV-Delivered Antibody Mediates Significant Protective Effects against SIVmac239 Challenge in the Absence of Neutralizing Activity. PLoS Pathogens. Aug. 2015;11(8):e1005090.
Fuchs SP, et al. Promise and problems associated with the use of recombinant AAV for the delivery of anti-HIV antibodies. Mol Ther Methods Clin Dev. Nov. 2016;3:16068.
Fuchs SP, et al. Recombinant AAV Vectors for Enhanced Expression of Authentic IgG. PLoS One. Jun. 2016;11(6):e0158009.
Gardner MR, et al. Engineering antibody-like inhibitors to prevent and treat HIV-1 infection. Curr Opin HIV AIDS. Feb. 21, 2017. Epub ahead of print.
Martinez-Navio JM, et al. Host anti-antibody responses following adeno-associated virus mediated delivery of antibodies against HIV and SIV in Rhesus monkeys. Mol Ther. Feb. 2016;24(1):76-86.
Schnepp BC, et al. Vector mediated antibody gene transfer for infectious disease. Adv Exp Med Biol. 2015;848:149-67.
Deal CE, et al. Engineering humoral immunity as prophylaxis or therapy. Curr Opin Immunol. Aug. 2015;35:113-22.
Adam VS, et al. Adeno-associated virus 9-mediated airway expression of antibody protects old and immunodeficient mice against influenza virus. Clin Vaccine Immunol. Nov. 2014;21(11):1528-33.
Singer J, et al. Proof of concept study with an HER-2 mimotope anticancer vaccine deduced from a novel AAV-mimotope library platform. Oncoimmunology. Apr. 2016;5(7):e1171446.
Hicks MJ, et al. Anti-Epidermal Growth Factor Receptor Gene Therapy for Glioblastoma. PLoS One. Oct. 2016;11(10):e0162978.
Amaro IA et al. An Intrabody Drug (rAAV6-INT41) Reduces the Binding of N-Terminal Huntingtin Fragment(s) to DNA to Basal Levels in PC12 Cells and Delays Cognitive Loss in the R6/2 Animal Model. J Neurodegener Dis. 2016;2016:7120753.
Gardner MR, et al. AAV-expressed eCD4-Ig provides durable protection from multiple SHIV challenges. Nature. Mar. 2015, 519(7541):87-91.
Limberis MP, et al. AAV9-expressed ZMapp in mice confers protection against systemic and airway-acquired Ebola virus infection. J Infect Dis. Dec. 2016;214(12):1975-1979.
Morabito G, Giannelli SG, Ordazzo G, Bido S, Castoldi V, Indrigo M, Cabassi T, Cattaneo S, Luoni M, Cancellieri C, Sessa A, Bacigaluppi M, Taverna S, Leocani L, Lanciego JL, Broccoli V. Mol Ther. Dec. 6, 2017;25(12):2727-2742. Epub Aug. 10, 2017.
Robert MA, Nassoury N, Chahal PS, Venne MH, Racine T, Qiu X, Kobinger G, Kamen A, Gilbert R, Gaillet B. Hum Gene Ther. Nov. 27, 2017. [Epub ahead of print].
Matsuzaki Y, Konno A, Mochizuki R, Shinohara Y, Nitta K, Okada Y, Hirai H. Neurosci Lett. Nov. 23, 2017. [Epub ahead of print].
Naidoo J, et al. Extensive Transduction and Enhanced Spread of a Modified AAV2 Capsid in the Non-human Primate CNS. Mol Ther. Jul. 12, 2018 Epub ahead of print.
Van Lieshout LP, et al. A Novel Triple-Mutant AAV6 Capsid Induces Rapid and Potent Transgene Expression in the Muscle and Respiratory Tract of Mice. Mol Ther Meth Clin Dev Jun. 15, 2018.
Wu XL, et al. Tandem bispecific neutralizing antibody eliminates HIV-1 infection in humanized mice. J Clin Invest Jun. 1, 2018;128(6):2239-2251.
Carter BJ. Adeno-associated virus and the development of adeno-associated virus vectors: a historical perspective. Mol Ther. Dec. 2004;10(6):981-9.
G. S. Banker, Modern Pharmaceutics, Drugs and the Pharmaceutical Sciences, v. 72, Marcel Dekker, New York, Inc., 1996.

(56) References Cited

OTHER PUBLICATIONS

Grimm D, et al. Progress in adeno-associated virus type 2 vector production: promises and prospects for clinical use. Hum Gene Ther. Oct. 10, 1999;10(15):2445-50.
Grimson A, et al. MicroRNA targeting specificity in mammals: determinants beyond seed pairing. Mol Cell. Jul. 6, 2007;27(1):91-105.
Hastie E, et al. Adeno-Associated Virus at 50: A Golden Anniversary of Discovery, Research, and Gene Therapy Success—A Personal Perspective. Hum Gene Ther. May 2015, 26(5):257-65.
Aydemir F, et al. Mutants at the 2-fold interface of AAV2 structural proteins suggest a role in viral transcription for AAV capsids. J Virol. Jul. 2016;90(16):7196-204.
Bantel-Schaal U, et al. Human adeno-associated virus type 5 is only distantly related to other known primate helper-dependent parvoviruses. J Virol. Feb. 1999;73(2):939-47.
Berry GE, et al. Cellular transduction mechanisms of adeno-associated viral vectors. Curr Opin Virol. Dec. 2016;21:54-60.
Chiorini JA, et al. Adeno-associated virus (AAV) type 5 Rep protein cleaves a unique terminal resolution site compared with other AAV serotypes. J Virol. May 1999;73(5):4293-8.
Chiorini JA, et al. Cloning and characterization of adeno-associated virus type 5. J Virol. Feb. 1999;73(2):1309-19.
Chiorini JA, et al. Cloning of adeno-associated virus type 4 (AAV4) and generation of recombinant AAV4 particles. J Virol. Sep. 1997;71(9):6823-33.
Earley LF, et al. Adeno-Associated Virus Assembly-Activating Protein Is Not an Essential Requirement for Capsid Assembly of AAV Serotypes 4, 5 and 11. J Virol. Jan. 2017;91(3):pii:e0198-16.
Ding C, et al., Biochemical Characterization of Junonia Coenia Densovirus Nonstructural Protein NS-1. J. Virol., 76(1):338-345 2002.
Adachi K, et al. Drawing a high-resolution functional map of adeno-associated virus capsid by massively parallel sequencing. Nat Commun. 2014;5:3075. doi: 10.1038/ncomms4075.
Altschul SF, et al. Basic local alignment search tool. J Mol Biol. Oct. 5, 1990;215(3):403-10.
Carillo H, et al. The Multiple Sequence Alignment Problem in Biology. SIAM J. Appl. Math. 48-5 (1988), pp. 1073-1082.
Devereux J A comprehensive set of sequence analysis programs for the VAX. Nucleic Acids Res. Jan. 11, 1984;12(1 Pt 1):387-95.
Gribskov M, et al. Sequence Analysis Primer. M Stockton Press, New York, 1991.
Griffin AM, et al. Computer Analysis of Sequence Data, Part I. Humana Press, New Jersey, 1994.
Berge SM Pharmaceutical salts. J Pharm Sci. Jan. 1977;66(1):1-19.
Bell P, et al. Effects of self-complementarity, codon optimization, transgene, and dose on liver transduction with AAV8. Hum Gene Ther Methods. Dec. 2016;27(6):228-237.
Heim et al., Wavelength mutations and posttranslational autoxidation of green fluorescent protein. Proc. Natl. Acad. Sci. USA (1994).
Hastie E, et al. Recombinant adeno-associated virus vectors in the treatment of rare diseases. Expert Opin Orphan Drugs. 2015;3(6):675-689.
Fargnoli AS, et al. Liquid jet delivery method featuring S100A1 gene therapy in the rodent model following acute myocardial infarction. Gene Ther. Feb. 2016;23(2):151-7.
Aubourg P. Gene therapy for rare central nervous system diseases comes to age. Endocr Dev. 2016;30:141-6.
Bankiewicz KS et al. AAV Viral Vector Delivery to the Brain by Shape-conforming MR-guided Infusions. J Control Release. Oct. 28, 2016;240:434-442.
Bey K, et al. Efficient CNS targeting in adult mice by intrathecal infusion of single-stranded AAV9-GFP for gene therapy of neurological disorders. Gene Ther. Apr. 20, 2017. Epub ahead of print.
Brulet R, et al. NEUROD1 Instructs Neuronal Conversion in Non-Reactive Astrocytes. Stem Cell Reports. May 11, 2017. Epub ahead of print.
Cabral-Miranda F, et al. rAAV8-733-Mediated Gene Transfer of CHIP/Stub-1 Prevents Hippocampal Neuronal Death in Experimental Brain Ischemia. Mol Ther. Feb. 2017;25(2):392-400.
Chandler Rj, et al. Systemic AAV9 gene therapy improves the lifespan of mice with Niemann-Pick disease, type C1. Hum Mol Genet. Jan. 2017;26(1):52-64.
Dang CH, et al. In vivo dynamics of AAV-mediated gene delivery to sensory neurons of the trigeminal ganglia. Sci Rep. Apr. 19, 2017;7(1):927.
Dimidschstein J, et al. A viral strategy for targeting and manipulating interneurons across vertebrate species. Nat Neurosci. Dec. 2016;19(12):1743-1749.
Donsante A et al. Intracerebroventricular delivery of self-complementary adeno-associated virus serotype 9 to the adult rat brain. Gene Ther. May 2016;23(5):401-7.
El-Shamayleh Y, et al. Strategies for targeting primate neural circuits with viral vectors. J Neurophysiol. Jul. 2016;116(1):122-34.
Foust KD, et al. Intravascular AAV9 preferentially targets neonatal neurons and adult astrocytes. Nat Biotechnol. Jan. 2009;27(1):59-65. doi: 10.1038/nbt.1515. Epub Dec. 21, 2008.
Gessler DJ et al. Gene Therapy for the Treatment of Neurological Disorders: Metabolic Disorders. Methods Mol Biol. 2016;1382:429-65.
Gilkes JA et al. Preferred Transduction with AAV8 and AAV9 via Thalamic Administration in the MPS IIIB Model: A Comparison of Four rAAV Serotypes. Mol Genet Metab Rep. Dec. 7, 2015;6:48-54.
Gombash SE, et al. Systemic Gene Therapy for Targeting the CNS. Methods Mol Biol. 2016;1382:231-7.
Gurda BL, et al. Evaluation of AAV-mediated gene therapy for central nervous system disease in canine mucopolysaccharidosis VII. Mol Ther. Feb. 2016;24(2):206-16.
Ahmed SS, et al. rAAV gene therapy in a Canavan's disease mouse model reveals immune impairments and an extended pathology beyond the central nervous system. Mol Ther. Jun. 2016;24(6):1030-41.
Dashkoff J, et al. Tailored transgene expression to specific cell types in the central nervous system after peripheral injection with AAV9. Mol Ther Methods Clin Dev. Dec. 2016;3:16081.
Gruntman AM, et al. Retro-Orbital Venous Sinus Delivery of rAAV9 Mediates High-Level Transduction of Brain and Retina Compared with Temporal Vein Delivery in Neonatal Mouse Pups. Hum Gene Ther. Mar. 2017;28(3):228-230.
Aoyama Y, et al. Wnt11 gene therapy with adeno-associated virus 9 improves the survival of mice with myocarditis induced by coxsackievirus B3 through the suppression of the inflammatory reaction. J Mol Cell Cardiol. Jul. 2015;84:45-51.
Greig JA, et al. Impact of intravenous infusion time on AAV8 vector pharmacokinetics, safety, and liver transduction in cynomolgus macaques. Mol Ther Methods Clin Dev. Dec. 2016;3:16079.
Gruntman AM, et al. Delivery of Adeno-associated virus gene therapy by intravascular limb infusion methods. Hum Gene Ther Clin Dev Sep. 2015;26(3):159-64.
Hagg A, et al. Using AAV vectors expressing the beta 2-adrenoceptor or associated G alpha proteins to modulate skeletal muscle mass and muscle fiber size. Sci Rep. Mar. 2016;6:23042.
Greig JA, et al. Intramuscular administration of AAV overcomes pre-existing neutralizing antibodies in rhesus macaques. Vaccine. Dec. 2016;34(50):6323-6329.
Al J, et al. Adeno-associated virus serotype rh.10 displays strong muscle tropism following intraperitoneal delivery. Sci Rep. Jan. 2017;7:40336.
Baum BJ, et al. Advances in salivary gland gene therapy—oral and systemic implications. Expert Opinion on Biological Therapy. 2015;15(10):1443-54.
Hai B, et al. Long-term transduction of miniature pig parotid glands using serotype 2 adeno-associated viral vectors. J Gene Med. Jun. 2009;11(6):506-14.
Mietzsch M, et al. OneBac 2.0: Sf9 Cell Lines for Production of AAV1, AAV2 and AAV8 Vectors with Minimal Encapsidation of Foreign DNA. Hum Gene Ther Methods. Feb. 2017;28(1):15-22.
Mietzsch M, et al. OneBac 2.0: Sf9 cell lines for production of AAV5 vectors with enhanced infectivity and minimal encapsidation of foreign DNA. Hum Gene Ther. Oct. 26, 2015(10):688-97.

(56) References Cited

OTHER PUBLICATIONS

Nambiar B, et al. Characteristics of minimally oversized adeno-associated virus vectors encoding human Factor VIII generated using producer cell lines and triple transfection. Hum Gene Ther Methods. Feb. 2017;28(1):23-38.
Pacouret S, et al. AAV-ID: A Rapid and Robust Assay for Batch-to-Batch Consistency Evaluation of AAV Preparations. Mol Ther. Apr. 17, 2017. Epub ahead of print.
Penaud-Budloo M, et al. Accurate identification and quantification of DNA species by next-generation sequencing in adeno-associated viral vectors produced in insect cells. Hum Gene Ther Methods. May 2, 2017. Epub ahead of print.
Ruffing M, et al. Assembly of viruslike particles by recombinant structural proteins of adeno-associated virus type 2 in insect cells. J Virol. Dec. 1992;66(12):6922-30.
Samulski RJ, et al. Helper-free stocks of recombinant adeno-associated viruses: normal integration does not require viral gene expression. J Virol. Sep. 1989;63(9):3822-8.
Smith RH, et al. A simplified baculovirus-AAV expression vector system coupled with one-step affinity purification yields high-titer rAAV stocks from insect cells. Mol Ther. Nov. 2009;17(11):1888-96. doi: 10.1038/mt.2009.128. Epub Jun. 16, 2009.
Urabe M, et al. Scalable generation of high-titer recombinant adeno-associated virus type 5 in insect cells. J Virol. Feb. 2006;80(4):1874-85.
Van Der Loo JCM, et al. Progress and challenges in viral vector manufacturing. Hum Mol Genet. Apr. 2016;25(R1):R42-52.
Wasilko DJ, et al. The titerless infected-cells preservation and scale-up (TIPS) method for large-scale production of NO-sensitive human soluble guanylate cyclase (sGC) from insect cells infected with recombinant baculovirus. Protein Expr Purif. Jun. 2009;65(2):122-32. doi: 10.1016/j.pep.2009.01.002. Epub Jan. 11, 2009.
Zhao KN, et al. BPV1 E2 protein enhances packaging of full-length plasmid DNA in BPV1 pseudovirions. Virology. Jul. 5, 2000;272(2):382-93.
Pierson EE, et al. Resolving adeno-associated viral particle diversity with charge detection mass spectrometry. Anal Chem. Jul. 2016;88(13):6718-25.
Rashnonejad A, et al. Large-Scale Production of Adeno-Associated Viral Vector Serotype-9 Carrying the Human Survival Motor Neuron Gene. Mol Biotechnol. Jan. 2016;58(1):30-6.
Ling C, et al. Strategies to generate high-titer, high-potency recombinant AAV3 serotype vectors. Mol Ther Methods Clin Dev. May 2016;3:16029.
Afione S, et al. Identification and Mutagenesis of the Adeno-Associated Virus 5 Sialic Acid Binding Region.J Virol. Feb. 2015, 89(3):1660-72.
Drouin LM, et al. Cryo-electron microscopy reconstruction and stability studies of Wild-Type and R432A Variant of AAV2 Reveals Capsid Structural Stability is a Major Factor in Genome Packaging. J Virol. Sep. 2016;90(19):8542-51.
Halder S, et al. Structure of neurotropic adeno-associated virus AAVrh.8. J Struct Biol. Oct. 2015;192(1):21-36.
Huang LY, et al. Characterization of the adeno-associated virus 1 and 6 sialic acid binding site. J Virol. May 2016;90(11):5219-30.
Mao Y, et al. Single point mutation in adeno-associated viral vectors—DJ capsid leads to improvement for gene delivery in vivo. BMC Biotechnol. Jan. 2016;16:1.
Marsic D et al. Altering Tropism of rAAV by Directed Evolution. Methods of Mol Biol. 2016;1382:151-73.
Tu MY, et al. Role of capsid proteins in parvoviruses infection. Virol J. Aug. 2015, 4;12:114.
Zeng C, et al. Probing the Link between Genomic Cargo, Contact Mechanics and Nanoindentation in Recombinant Adeno-Associated Virus 2. J Phys Chem B. Mar. 2017;121(8):1843-1853.
Zinn E, et al. In Silico Reconstruction of the Viral Evolutionary Lineage Yields a Potent Gene Therapy Vector. Cell Rep. Aug. 2015, 12(6):1056-68.

Grimm D, et al. E Pluribus Unum: 50 years of research, millions of viruses and one goal—tailored acceleration of AAV evolution. Mol Ther. Dec. 2015;23(12):1819-1831.
Karamuthil-Melethil S, et al. Novel Vector Design and Hexosaminidase Variant Enabling Self-Complementary Adeno-Associated Virus for the Treatment of Tay-Sachs Disease. Hum Gene Ther. Jul. 2016;27(7):509-21.
Ling C, et al. Development of Optimized AAV Serotype Vectors for High-Efficiency Transduction at Further Reduced Doses. Hum Gene Ther Methods. Aug. 2016;27(4):143-9.
Pillay S, et al. An essential receptor for adeno-associated virus infection. Nature. Feb. 2016;530(7588):108-12.
Li BZ, et al. Site directed mutagenesis of surface-exposed lysine residues leads to improved transduction by AAV2 but not AAV8 vectors in murine hepatocytes in vivo. Hum Gene Ther Methods. Dec. 2015;26(6):211-20.
Shen S, et al. Functional Analysis of the Putative Integrin Recognition Motif on Adeno-associated virus 9. J Biol Chem. Jan. 2015, 290(3):1496-504.
Steines B, et al. CFTR gene transfer with AAV improves early cystic fibrosis pig phenotypes. JCI Insight. Sep. 2016;1(14):e88728.
Bensky MJ, et al. Targeted gene delivery to the enteric nervous system using AAV: a comparison across serotypes and capsid mutants.Mol Ther. Mar. 2015;23(3):488-500.
Castle MJ, et al. Controlling AAV Tropism in the Nervous System with Natural and Engineered Capsids. Methods Mol Biol. 2016;1382:133-49.
Choudhury SR, et al. Widespread CNS gene transfer and silencing after systemic delivery of novel AAV-AS vectors. Mol Ther. Apr. 2016;24(4):726-35.
Davis AS, et al. Rational design and engineering of a modified adeno-associated virus (AAV1)-based vector system for enhanced retrograde gene delivery. Neurosurgery. Feb. 2015;76(2):216-25.
Deverman BE et al. Cre-dependent selection yields AAV variants for widespread gene transfer to the adult brain. Nat Biotechnol. Feb. 2016;34(2):204-9.
Powell SK et al. Characterization of a novel adeno-associated viral vector with preferential oligodendrocyte tropism. Gene Ther. Sep. 15, 2016.
Tervo et al. A Designer AAV Variant Permits Efficient Retrograde Access to Projection Neurons. Neuron. Oct. 19, 2016;92(2):372-382.
Choudhury et al. In Vivo Selection Yields AAV-B1 Capsid for Central Nervous System and Muscle Gene Therapy. Mol Ther. Aug. 2016;24(7):1247-57.
Keravala A, et al. Evaluating AAV Hybrid Variants for Improved Tropism after Intravitreal Gene Delivery to the Retina. Molecular Therapy, vol. 23, Supplement 1, May 2015, pp. S127-S128.
Vercauteren K, et al. Superior in vivo Transduction of Human Hepatocytes Using Engineered AAV3 Capsid. Mol Ther. Jun. 2016;24(6):1042-9.
Chen M, et al. Efficient Gene Delivery and Expression in Pancreas and Pancreatic Tumors by Capsid-optimized AAV8 Vectors. Hum Gene Ther Methods. Feb. 2017;28(1):49-59.
Ling C, et al. High-Efficiency Transduction of Primary Human Hematopoietic Stem/Progenitor Cells by AAV6 Vectors: Strategies for Overcoming Donor-Variation and Implications in Genome Editing. Sci Rep. Oct. 2016;6:35495.
Earley LF, et al. Identification and Characterization of Nuclear and Nucleolar Localization Signals in the Adeno-Associated Virus Serotype 2 Assembly-Activating Protein. J Virol. Mar. 2015, 89(6):3038-48.
Zou W, et al. Nonstructural protein NP1 of human bocavirus 1 plays a critical role in the expression of viral capsid proteins. J Virol. Apr. 2016;90(9):4658-69.
Mingozzi F, et al. Adeno-associated viral vectors at the frontier between tolerance and immunity. Front Immunol.Mar. 2015, 6:120.
Ling C, et al. Enhanced Transgene Expression from Recombinant Single-Stranded D-Sequence-Substituted Adeno-Associated Virus Vectors in Human Cell Lines In Vitro and in Murine Hepatocytes In Vivo. J Virol. Jan. 2015, 89(2):952-61.
Xie J, et al. Short DNA Hairpins Compromise Recombinant Adeno-Associated Virus Genome Homogeneity. Mol Ther. Apr. 24, 2017. Epub ahead of print.

(56) References Cited

OTHER PUBLICATIONS

Davidsson M, et al. A novel process of viral vector barcoding and library preparation enables high-diversity library generation and recombination-free paired-end sequencing. Sci Rep. Nov. 2016;6:3563.
Chamberlain K, et al. Expressing transgenes that exceed the packaging capacity of AAV capsids. Hum Gene Ther Methods. Feb. 2016;27(1):1-12.
Deal, CE et al. Vectored antibody gene delivery for the prevention of treatment of HIV infection. HIV and AIDS. May 2015, vol. 10, No. 3; pp. 190-197.
Achour, I et al. Tetrameric and Homodimeric Camelid IgGs Originate from the SAme IgH Locus The Journal of Immunology. Aug. 1, 2008, vol. 181, No. 3; pp. 2001-2009.
International Search Report & Written Opinion dated Oct. 20, 2017 in co-pending application No. PCT/US2017/030061, entitled Compositions for the Treatment of Disease.
Maniatis T. et al.,Molecular Cloning. CSH Laboratory, NY, N.Y. (1982).
Merten OW, et al. Viral vectors for gene therapy and gene modification approaches. Biochem Eng J. Apr. 2016;108:98-115.
Muzyczka N, et al. AAV's Golden Jubilee. Mol Ther. May 2015;23(5):807-8.
Philiport, et al. Liposomes as tools in Basic Research and Industry. CRC Press, Ann Arbor, Mich. (1995).
Kailasan S, et al. Parvovirus Family Conundrum: What makes a killer? Annu Rev Virol. Nov. 2015;2(1):425-50.
Rutledge EA, et al. Infectious clones and vectors derived from adeno-associated virus (AAV) serotypes other than AAV type 2. J Virol. Jan. 1998;72(1):309-19.
Pillay S, et al. An essential receptor for adeno-associated virus infection. Nature. Nov. 17, 2016;539(7629):456.
Platt MP, et al. Embryonic disruption of the candidate dyslexia susceptibility gene homolog Kiaa0319-like results in neuronal migration disorders. Neuroscience. Sep. 17, 2013;248:585-93.
Poon MW, et al. Distribution of Kiaa0319-like immunoreactivity in the adult mouse brain—a novel protein encoded by the putative dyslexia susceptibility gene KIAA0319-like. Histol Histopathol. Aug. 2011;26(8):953-63.
Poon MW, et al. Dyslexia-associated kiaa0319-like protein interacts with axon guidance receptor nogo receptor 1. Cell Mol Neurobiol. Jan. 2011;31(1):27-35.
Myers EW, et al. Optimal alignments in linear space. Comput Appl Biosci. Mar. 1988;4(1):11-7.
Smith DW, et al. Biocomputing: Informatics and Genome Projects. Academic Press, New York, 1993.
Kozak M. Interpreting cDNA sequences: some insights from studies on translation. Mamm Genome. Aug. 1996;7(8):563-74.
Kozak M. Point mutations define a sequence flanking the AUG initiator codon that modulates translation by eukaryotic ribosomes. Cell. Jan. 31, 1986;44(2):283-92.
Kozak M. The scanning model for translation: an update. J Cell Biol. Feb. 1989;108(2):229-41.
Heim R, et al. Engineering green fluorescent protein for improved brightness, longer wavelengths and fluorescence Resonance energy transfer. Curr Biol. Feb. 1, 1996;6(2):178-82.
Heim R,et al. Improved green fluorescence Nature 373, 663-664 (Feb. 23, 1995); doi:10.1038/373663b0.
Nygaard S, et al. A universal system to select gene-modified hepatocytes in vivo. Sci Transl Med. Jun. 2016;8(342):342ra79.
Smith RH, et al. Germline viral "fossils" guide in silico reconstruction of a mid-Cenozoic era marsupial adeno-associated virus. Sci Rep. Jul. 2016;6:28965.
Li L, et al. Production and characterization of novel recombinant adeno-associated virus replicative-form genomes: a eukaryotic source of DNA for gene transfer. PLoS One. Aug. 1, 2013;8(8):e69879. doi: 10.1371/journal.pone.0069879. Print 2013.
O'Reilly DR, et al. Baculovirus expression vectors: a laboratory manual. Oxford University Press, 1994.
Oliva B, et al. An automated classification of the structure of protein loops. J Mol Biol. Mar. 7, 1997;266(4):814-30.

Samaranch L, et al. MR-guided parenchymal delivery of adeno-associated viral vector serotype 5 in non-human primate brain. Gene Ther. Apr. 2017;24(4):253-261.
Petit L, et al. Rod Outer Segment Development Influences AAV-Mediated Photoreceptor Transduction After Subretinal Injection. Hum Gene Ther. May 16, 2017. Epub ahead of print.
Hinderer C et al. Delivery of an Adeno-Associated Virus Vector into CSF Attenuates Central Nervous System Disease in Mucopolysaccharidosis Type II Mice. Hum Gene Ther. Aug. 10, 2016.
Hordeaux J., et al. Efficient central nervous system AAVrh10-mediated intrathecal gene transfers in adult and neonate rats. Gene Ther.Apr. 2015, 22(4):316-24.
Merkel SF et al. Trafficking of AAV Vectors Across a Model of the Blood-Brain Barrier; a Comaparative Study of Transcytosis and Transduction Using Primary Human Brain Endothelial Cells. J Neurochem. Oct. 8, 2016.
Miyanohara A et al. Potent Spinal Parenchymal AAV9-mediated Gene Delivery by Subpial Injection in Adult Rats and Pigs. Mol Ther Methods Clin Dev. Jul. 13, 2016;3:16046.
Muralidharan G, et al. Unique glycan signatures regulate adeno-associated virus tropism in the developing brain. J Virol. Apr. 2015;89(7):3976-87.
Ponder K, et al. Intrathecal injection of lentiviral vector results in high expression in the brain of mucopolysaccharidosis VII dogs but the pattern of expression is different than for AAV9 or AAV-rh10. J Control Release. Dec. 2014, 196:71-8.
Salegio EA, et al. MRI-Guided Delivery of Viral Vectors. Methods Mol Viol. 2016;1382:217-30.
Samaranch L et al. Cerebellomedullary Cistern Delivery for AAV-Based Gene Therapy: A Technical Note for Nonhuman Primates. Hum Gene Ther Methods. Feb. 2016;27(1):13-6.
Saraiva J et al. Gene Therapy for the CNS Using AAVs: The Impact of Systemic Delivery by AAV9. J Control Release. Nov. 10, 2016;241:94-109.
Shen F, et al. Inhibition of pathological brain angiogenesis through systemic delivery of AAV vector expressing soluble FLT1. Gene Therapy. Nov. 22, 2015(11):893-900.
Hinderer C, et al. Neonatal Systemic AAV Induces Tolerance to CNS Gene Therapy in MPS I Dogs and Nonhuman Primates. Mol Ther. Aug. 2015, 23(8):1298-307.
Ojala DS, et al. Adeno-associated virus vectors and neurological gene therapy. Neuroscientist. Feb. 2015;21(1):84-98.
Katz ML, et al. AAV gene transfer delays disease onset in a TPP1-deficient canine model of the late infantile form of Batten Disease. Sci Transl Med. Nov. 2015;7(313):313ra180.
Kothari P, et al. Iodine-124 Labeled Adeno-Associated Virus: A Promising Tool for Tracking Gene Therapy. Journal of Nuclear Medicine. May 2015, 56 (supplement 3), 494-494.
Landegger LD, et al. A synthetic AAV vector enables safe and efficient gene transfer to the mammalian inner ear. Nat Biotechnol. Mar. 2017;35(3):280-284.
Mason JB, et al. Delivery and evaluation of recombinant adeno-associated viral vectors in the equine distal extremity for the treatment of laminitis. Equine Vet J. Jan. 2017;49(1):79-86.
Jeong D, et al. Matricellular Protein CCN5 Reverses Established Cardiac Fibrosis. J Am Coll Cardiol. Apr. 5, 2016;67(13):1556-68.
Knezevic T, et al. Adeno-associated Virus Serotype 9—Driven Expression of BAG3 Improves Left Ventricular Function in Murine Hearts with Left Ventricular Dysfunction Secondary to a Myocardial Infarction. JACC Basic Transl Sci. Dec. 2016;1(7):647-656.
Ibrahim S, et al. Stable liver specific expression of human IDOL in humanized mice raises plasma cholesterol. Cardiovasc Res. May 2016;110(1):23-9.
Li SY, et al. Efficient and targeted transduction of nonhuman primate liver with systemically delivered optimized AAV3B vectors. Mol Ther. Dec. 2015;23(12):1867-76.
Heller KN, et al. Human alpha 7 integrin gene (ITGA7) delivered by adeno-associated virus extends survival of severely affected dystrophin/utrophin deficient mice. Oct. 2015;26(10):647-56.
Mendell JR, et al. Follistatin Gene Therapy for Sporadic Inclusion Body Myositis Improves Functional Outcomes. Mol Ther. Apr. 2017;25(4):870-879.

(56) References Cited

OTHER PUBLICATIONS

Schnepp BC, et al. Recombinant adeno-associated virus vector genomes take the form of long-lived transcriptionally competent episomes in human muscle. Hum Gene Ther. Jan. 2016;27(1):32-42.
Murlidharan G et al. Glymphatic Fluid Transport Controls Paravascular Clearance of AAV Vectors from the Brain. JCI Insight. Sep. 8, 2016;1(14).
Neuberger EWI, et al. Establishment of two quantitative nested qPCR assays targeting the human EPO transgene. Gene Ther. Apr. 2016;23(4):330-9.
Lentz TB, et al. Insight into the Mechanism of Inhibition of Adeno-Associated Virus by the Mre11/Rad50/Nbs1 Complex. J Virol. Jan. 2015, 89(1):181-94.
Nicolson SC, et al. Identification and validation of small molecules that enhance recombinant Adeno-associated virus transduction following high throughput screen. J Virol. Jul. 2016;90(16):7019-31.
Wang M, et al. Direct interaction of human serum proteins with AAV virions to enhance AAV transduction: Immediate impact on clinical applications. Gene Ther. Jan. 2017;24(1):49-59.
Watakabe A, et al. Comparative analyses of adeno-associated viral vector serotypes 1 2 5 8 and 9 in marmoset mouse and macaque cerebral cortex. Neurosci Res.Apr. 2015, 93:144-57.
Xiao P, et al. Disruption of microtubules post virus entry enhances adeno-associated virus vector transduction. Hum Gene Ther. Apr. 2016;27(4):309-24.
Hudry EM, et al. Exosome-associated AAV vector as a robust and convenient neursocience tool. Gene Ther. Apr. 2016;23(4):380-92.
Nery FC, et al. New methods for investigation of neuronal migration in embryonic brain explants J Neurosci Methods.Jan. 2015, 239:80-4.
Su W et al. Recombinant adeno-associated viral (rAAV) vectors mediate efficient gene transduction in cultured neonatal and adult microglia. J Neurochem. Jan. 2016;136 Suppl 1:49-62.
Ren XF, et al. Adeno-associated virus-mediated BMP-7 and SOX9 in vitro co-transfection of human degenerative intervertebral disc cells. Genet Mol Res. Apr. 22, 2015;14(2):3736-44.
Alves S et al. Ultramicroscopy as a Novel Tool to Unravel the Tropism of AAV Gene Therapy Vectors in the Brain. Sci Rep. Jun. 20, 2016;6:28272.
Kothari P, et al. Radioiodinated Capsids Facilitate In Vivo Non-Invasive Tracking of Adeno-Associated Gene Transfer Vectors. Sci Rep. Jan. 2017;7:39594.
Xie Q, et al. The 2.8 Å Electron Microscopy Structure of Adeno-Associated Virus-DJ Bound by a Heparinoid Pentasaccharide. Mol Ther Methods Clin Dev. Mar. 8, 2017;5:1-12.
Srivastava A. Adeno-Associated Virus: The Naturally Occurring Virus Versus the Recombinant Vector. Hum Gene Ther. Jan. 2016;27(1):1-6.
Thorne B, et al. Gene Therapy. Adv Biochem Eng Biotechnol. Mar. 14, 2017 Epub ahead of print.
Tratschin JD, et al. Adeno-associated virus vector for high-frequency integration, expression, and rescue of genes in mammalian cells. Mol Cell Biol. Nov. 1985;5(11):3251-60.
Srivastava A, et al. Nucleotide sequence and organization of the adeno-associated virus 2 genome. J Virol. Feb. 1983;45(2):555-64.
Summerford C, et al. AAVR: A multi-serotype receptor for AAV. Mol Ther. Apr. 2016;24(4):663-6.
Xie Q, et al. The atomic structure of adeno-associated virus (AAV-2), a vector for human gene therapy. Proc Natl Acad Sci U S A. Aug. 6, 2002;99(16):10405-10. Epub Jul. 22, 2002.
Wu P, et al. Mutational analysis of the adeno-associated virus type 2 (AAV2) capsid gene and construction of AAV2 vectors with altered tropism. J Virol. Sep. 2000;74(18):8635-47.
Von Heinje G. Sequence Analysis in Molecular Biology. Academic Press, 1987.
Stahl PH, et al. Pharmaceutical Salts: Properties, Selection, and Use. Wiley-VCH, 2008.

Yang C, et al. Sequential adeno-associated viral vector serotype 9-green fluorescent protein gene transfer causes massive inflammation and intense immune response in rat striatum. Hum Gene Ther. Jul. 2016;27(7):528-43.
Chandler RJ, et al. rAAV integration and genotoxicity: insights from animal models. Hum Gene Ther. Apr. 2017;28(4):314-322.
Ye L., et al. Adeno-Associated Virus Vector Mediated Delivery of the HBV Genome Induces Chronic Hepatitis B Virus Infection and Liver Fibrosis in Mice. PLoS One. Jun. 2015, 10(6):e0130052.
Wang S, et al. Direct brain infusion can be enhanced with focused ultrasound and microbubbles. J Cereb Blood Flow Metab. Feb. 2017;37(2):706-714.
Wang et al., Noninvasive, neuron-specific gene therapy can be facilitated by focused ultrasound and recombinant adeno-associated virus. Gene Therapy. Nov. 22, 2014, 104-110.
Weber-Adrian D, et al. Gene delivery to the spinal cord using MRI-guided focused ultrasound. Gene Ther. Jul. 2015, 22(7):568-77.
Wu D et al. Expressing Constitutively Active Rheb in Adult Dorsal Root Ganglion Neurons Enhances the Integration of Sensory Axons that Regenerate Across a Chondroitinase-Treated Dorsal Root Entry Zone Following Dorsal Root Crush. Front Mol Neurosci. Jul. 5, 2016;9:49.
Zhu W, et al. Soluble FLT1 Gene Therapy Alleviates Brain Arteriovenous Malformation Severity. Stroke. May 2017;48(5):1420-1423.
Watson ZL, et al. Adeno-associated Virus Vectors Efficiently Transduce Mouse and Rabbit Sensory Neurons Coinfected with Herpes Simplex Virus 1 following Peripheral Inoculation. J Virol. Aug. 12, 2016;90(17):7894-901.
Suzuki J, et al. Cochlear gene therapy with ancestral AAV in adult mice: complete transduction of inner hair cells without cochlear dysfunction. Apr. 3, 2017;7:45524.
Woodard KT et al. Heparan Sulfate Binding Promotes Accumulation of Intravitreally Delivered Adeno-associated Viral Vectors at the Retina for Enhanced Transduction but Weakly Influences Tropism. J Virol. Oct. 14, 2016;90(21):9878-9888.
Wang LL, et al. Comparative study of liver gene transfer with AAV vectors based on endogenous and engineered AAV capsids. Mol Ther. Dec. 2015;23(12):1877-87.
Sondhi D, et al. Genetic Modification of the Lung Directed Toward Treatment of Human Disease. Hum Gene Ther. Jan. 2017;28(1):3-84.
Yalvac ME, et al. AAV1.NT-3 gene therapy attenuates spontaneous autoimmune peripheral polyneuropathy. Gene Ther. Jan. 2016;23(1):95-102.
Srivastava A. In Vivo Tissue-tropism of Adeno-associated Viral Vectors. Curr Opin Virol. Sep. 2, 2016;21:75-80.
Adamson-Small L, et al. Sodium chloride enhances rAAV production in a serum-free suspension manufacturing platform using the Herpes Simplex Virus System. Hum Gene Ther Methods. Feb. 2017;28(1):1-14.
Ai J, et al. A Scalable and Accurate Method for Quantifying Vector Genomes of Recombinant Adeno-Associated Viruses in Crude Lysate. Hum Gene Ther Methods. Apr. 13, 2017. Epub ahead of print.
Buclez PO, et al. Rapid, scalable, and low-cost purification of recombinant adeno-associated virus produced by baculovirus expression vector system. Mol Ther Methods Clin Dev. May 2016;3:16035.
Burnham B, et al. Analytical ultracentrifugation as an approach to characterize recombinant adeno-associated viral vectors. Hum Gene Ther Methods. Dec. 2015;26(6):228-42.
Clement N, et al. Manufacturing of recombinant adeno-associated viral vectors for clinical trials. Mol Ther Methods Clin Dev. Mar. 2016;3:16002.
D'Costa S, et al. Practical utilization of recombinant AAV vector reference standards: focus on vector genome titration by free ITR qPCR. Mol Ther Methods Clin Dev. Mar. 2016;5:16019.
Grieger JC, et al. Production of Recombinant Adeno-associated Virus Vectors Using Suspension HEK293 Cells and Continuous Harvest of Vector From the Culture Media for GMP FIX and FLT1 Clinical Vector. Mol Ther. Feb. 2016;24(2):287-97.

(56) References Cited

OTHER PUBLICATIONS

Gruntman AM, et al. Stability and Compatibility of Recombinant Adeno-Associated Virus Under Conditions Commonly Encountered in Human Gene Therapy Trials. Hum Gene Ther Methods. Apr. 2015, 26(2):71-6.

Kajigaya S, et al. Self-assembled B19 parvovirus capsids, produced in a baculovirus system, are antigenically and immunogenically similar to native virions. Proc Natl Acad Sci U S A. Jun. 1, 1991;88(11):4646-50.

Kirnbauer R, et al. Virus-like particles of bovine papillomavirus type 4 in prophylactic and therapeutic immunization. Virology. May 1, 1996;219(1):37-44.

Kohlbrenner E, et al. Production and Characterization of Vectors Based on the Cardiotropic AAV Serotype 9. Methods Mol Biol. 2017;1521:91-107.

Kotin RM, et al. Large-scale recombinant adeno-associated virus production. Hum Mol Genet. Apr. 15, 2011;20(R1):R2-6. doi: 10.1093/hmg/ddr141. Epub Apr. 29, 2011.

Kotin RM, et al. Manufacturing clinical grade recombinant adeno-associated virus using invertebrate cell lines. Hum Gene Ther. Mar. 28, 2017. Epub ahead of print.

Kotterman MA, et al. Enhanced cellular secretion of AAV2 by expression of foreign viral envelope proteins. Biochemical Engineering Journal, vol. 93, Jan. 15, 2015, pp. 108-114.

Methods in Molecular Biology, ed. Richard, Humana Press, NJ (1995).

\* cited by examiner

FIG. 3

Payload Region

1. [Heavy chain | A | Light chain]
2. [Light chain | A | Heavy chain]
3. [Heavy chain | B | Light chain]
4. [Light chain | B | Heavy chain]
5. [Heavy chain | C|B | Light chain]
6. [Light chain | C|B | Heavy chain]
7. [Heavy chain | D | Light chain]
8. [Light chain | D | Heavy chain]
9. [Heavy chain | C|D | Light chain]
10. [Light chain | C|D | Heavy chain]
11. [Light chain | E | Heavy chain]

A – IRES
B – Foot and mouth disease virus
C – Furin cleavage site
D – Porcine Teschovirus-1 Virus
E – 5xG4S

- Heavy chain
- Light chain

COMPOSITIONS FOR THE TREATMENT OF DISEASE

CROSS REFERENCE TO RELATED APPLICATIONS

This application is a 35 U.S.C. § 371 U.S. National Stage Entry of International Application No. PCT/US2017/030061 filed Apr. 28, 2017, which claims priority to U.S. Provisional Patent Application No. 62/329,468, entitled COMPOSITIONS FOR THE TREATMENT OF DISEASE, filed Apr. 29, 2016 and U.S. Provisional Patent Application No. 62/329,479, entitled COMPOSITIONS FOR THE TREATMENT OF DISEASE, filed Apr. 29, 2016; the contents of each of which are herein incorporated by reference in their entirety.

REFERENCE TO SEQUENCE LISTING

The instant application contains a Sequence Listing which has been submitted electronically in ASCII format and is hereby incorporated by reference in its entirety. Said ASCII copy, created on Oct. 29, 2018 is named 20571302US371 SL and is 14,170,304 bytes in size.

FIELD OF THE INVENTION

The invention relates to compositions and methods for vectored antibody delivery (VAD).

BACKGROUND OF THE INVENTION

Antibody-based therapies have been developed for a wide variety of diseases, disorders and conditions, including infectious and non-infectious diseases. The U.S. Food and Drug Administration (FDA) has approved antibodies for treatment of cancers, autoimmune and immune system disorders, ocular diseases, nervous system diseases, inflammations, and infections, amongst many others. Naturally, antibodies are components of the adaptive immune response and they function by recognizing specific foreign antigens and stimulating humoral immunity responses. As a consequence, antibodies may be applied to the treatment, prevention, management, diagnosis and research of diseases, disorders and/or conditions.

Antibodies have relatively short half-lives and this presents an ongoing and long-felt challenge for antibody-based therapies. In order to achieve a sufficiently high concentration of an antibody for long lasting therapeutic effects, antibody therapies are traditionally delivered by repeated administration, e.g. by multiple injections. This dosing regimen results in an inconsistent level of antibody throughout the treatment period, limited efficiency per administration, high cost of administration and consumption of the antibody. Hence, there remains a need in the art for delivery of antibodies and antibody-based therapeutics through alternative routes or modalities of administration.

One such alternative route of administration is by expression vector (e.g. plasmid or viral vector), including but not limited to, adeno-associated viral vectors (AAVs). Adeno-associated viral vectors are widely used in gene therapy approaches due to a number of advantageous features. As dependoparvoviruses, AAV are non-replicating in infected cells and therefore not associated with any known disease. Further, AAVs may be introduced to a wide variety of host cells, do not integrate into the genome of the host cell, and are capable of infecting both quiescent and dividing cells. AAVs transduce non-replicating and long-lived cells in vivo, resulting in long term expression of the protein of interest. Further, AAVs can be manipulated with cellular and molecular biology techniques to produce non-toxic particles carrying a payload encoded in the AAV viral genome that can be delivered to a target tissue or set of cells with limited or no side-effects. Given the foregoing, the use of AAVs for vectored antibody delivery (VAD) would allow for longer lasting efficacy, fewer dose treatments, and more consistent levels of the antibody throughout the treatment period.

In vectored antibody delivery (VAD) an AAV is used as the delivery modality for a nucleic acid sequence encoding the antibody, which results in in vivo expression of the encoded payload, e.g., functional antibody.

The mechanism underlying VAD is thought to proceed through the following steps. First the AAV vector enters the cell via endocytosis, then escapes from the endosomal compartment and is transported to the nucleus wherein the viral genome is released and converted into a double-stranded episomal molecule of DNA by the host. The transcriptionally active episome results in the expression of encoded antibodies that may then be secreted from the cell into the circulation. VAD may therefore enable continuous, sustained and long-term delivery of antibodies administered by a single injection of an AAV particle.

Previous studies of an AAV-mediated antibody technique known as vectored immunoprophylaxis (VIP) have focused on neutralization of human immunodeficiency virus (HIV) (see, e.g. Johnson et al., 2009, Nature Med., 15, 901-906, Saunders et al., 2015, J. Virol., 89(16), 8334-8345, Balasz et al., 2012, Nature 481, 81-84, the contents of which are incorporated herein by reference in their entirety). Balasz et al. reported a long-term, even lifelong, expression of monoclonal antibody at high concentration from a single intramuscular administration in mice that resulted in full protection against HIV infection. AAV-mediated VIP has also been demonstrated against influenza strains (see, e.g. Balasz et al. Nat. Biotechnol., 2013, 31(7):647-52) and *Plasmodium falciparum*, a sporozoite causing malaria infection (see, e.g. Deal at al., 2014, PNAS, 111 (34), 12528-12532), as well as cancer, RSV and drug addiction (see, e.g. review by Schnepp and Johnson, Microbiol. Spectrum 2(4), 2014). Though promising, these studies emphasize efforts to merely prevent disease. There still remains a need for improved methods of prevention, and new antibody-mediated therapies for research, diagnosis, and treatment of disease.

The present invention addresses this need by providing novel AAV particles having viral genomes engineered to encode antibodies and antibody-based compositions and methods of using these constructs (e.g., VAD) for the treatment, prevention, diagnosis and research of diseases, disorders and/or conditions. The present invention further embraces optimized AAV particles for delivery of nucleic acids (e.g., viral genomes) encoding antibodies and antibody-based compositions to a subject in need thereof.

SUMMARY OF THE INVENTION

The invention provides AAV particles comprising a capsid and a viral genome, said viral genome comprising at least one inverted terminal repeat (ITR) region and a payload region, said payload region comprising a regulatory sequence operably linked to at least a first nucleic acid segment, said first nucleic acid segment encoding one or more polypeptides given in Tables 3-42, variants and fragments thereof. The capsid of the AAV particle may be any of the serotypes described herein and/or described in Table 1.

In one aspect, the first nucleic acid segment may encode one or more polypeptides such as, but not limited to, an antibody heavy chain, an antibody light chain, a linker, and combinations thereof. The first nucleic acid segment may encode one or more polypeptides which is humanized. As a non-limiting example, the first nucleic acid segment encodes from 5' to 3', an antibody heavy chain, a linker, and an antibody light chain. As another non-limiting example, the first nucleic acid segment encodes from 5' to 3', an antibody light chain, a linker, and an antibody heavy chain. As yet another non-limiting example, the first nucleic acid segment encodes one or more antibody heavy chains. As yet another non-limiting example, the first nucleic acid segment encodes one or more antibody light chains.

In one aspect, the first nucleic acid segment encodes an antibody, having at least 95% identity to any of the sequences of Tables 3-42 (SEQ ID NO: 2948-9220).

In one aspect, the regulatory sequence may comprise a promoter such as but not limited to, human elongation factor 1α-subunit (EF1α), cytomegalovirus (CMV) immediate-early enhancer and/or promoter, chicken β-actin (CBA) and its derivative CAG, 1(glucuronidase (GUSB), or ubiquitin C (UBC). Tissue-specific expression elements can be used to restrict expression to certain cell types such as, but not limited to, muscle specific promoters, B cell promoters, monocyte promoters, leukocyte promoters, macrophage promoters, pancreatic acinar cell promoters, endothelial cell promoters, lung tissue promoters, astrocyte promoters, or nervous system promoters which can be used to restrict expression to neurons, astrocytes, or oligodendrocytes.

In one aspect, the linker in the viral genome is selected from one or more of the linkers given in Table 2.

In one aspect, the AAV particles described herein may comprise a viral genome which is single stranded.

In one aspect, the AAV particles described herein may comprise a viral genome which is self-complementary.

In one aspect, the AAV particles described herein may comprise a viral genome comprising at least one intron sequence.

In one aspect, the AAV particles described herein may comprise a viral genome comprising at least one stuffer sequence to adjust the length of the viral genome to increase efficacy and/or efficiency.

In one aspect, the AAV particles described herein may comprise at least one region which has been codon optimized. As a non-limiting example, the viral genome may be codon optimized. As another non-limiting example, the first nucleic acid segment is codon-optimized.

In one aspect, the AAV particles described herein may comprise a viral genome with 2 ITR regions. At least one of the ITR regions may be derived from the same or different parental serotype of the capsid. As a non-limiting example, at least one ITR region is derived from AAV2.

In one aspect, the AAV particles comprise a viral genome which comprises a second nucleic acid segment. The second nucleic acid segment may encode an aptamer, siRNA, saRNA, ribozyme, microRNA, mRNA or combination thereof.

In one aspect, the AAV particles comprise a viral genome which comprises a second nucleic acid segment encoding an siRNA designed to target the mRNA that encodes the target of the antibody encoded by the first nucleic acid segment.

In one aspect, the AAV particles comprise a viral genome which comprises a second nucleic acid segment encoding a microRNA, the microRNA is selected to target the mRNA that encodes the target of the antibody encoded by the first nucleic acid segment.

In one aspect, the AAV particles comprise a viral genome which comprises a second nucleic acid segment encoding an mRNA, the mRNA encodes one or more peptides inhibitors of the same target of the antibody encoded by the first nucleic acid segment.

In one aspect, the AAV particles comprise a viral genome which comprises a third nucleic acid segment. The third nucleic acid segment may encode a nuclear export signal, a polynucleotide or polypeptide which acts as a regulator of expression of the viral genome in which it is encoded, a polynucleotide or polypeptide which acts as a regulator of expression of the payload region of the viral genome in which it is encoded and/or a polynucleotide or polypeptide which acts as a regulator of expression of the first nucleic acid segment of the payload region of the viral genome in which it is encoded.

The invention provides AAV particles comprising a capsid and a viral genome, said viral genome comprising at least one inverted terminal repeat (ITR) region and a payload region comprising a regulatory sequence operably linked to at least a first nucleic acid segment, the first nucleic acid segment encoding a bispecific antibody derived from any of the sequences listed in Tables 3-42 or portions or fragments thereof.

The invention provides methods of producing a functional antibody in a subject in need thereof, comprising administering to a subject the AAV particles described herein. The level or amount of the functional antibody in the target cell or tissue after administration to the subject may be from about 0.001 ug/mL to 100 mg/mL. The functional antibody may be encoded by a single first nucleic acid segment of a viral genome within the AAV particle. The functional antibody may be encoded by two different viral genomes, the two different viral genomes may be packaged in separate capsids.

The invention provides a pharmaceutical composition comprising an AAV particle described herein in a pharmaceutically acceptable excipient. As a non-limiting example, the pharmaceutically acceptable excipient is saline. As a non-limiting example, the pharmaceutically acceptable excipient is 0.001% pluronic in saline.

The invention provides methods of producing a functional antibody in a subject in need thereof, comprising administering to a subject the AAV particles described herein by a delivery route such as, but not limited to, enteral (into the intestine), gastroenteral, epidural (into the dura mater), oral (by way of the mouth), transdermal, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intra-arterial (into an artery), intramuscular (into a muscle), intracardiac (into the heart), intraosseous infusion (into the bone marrow), intrathecal (into the spinal canal), intraparenchymal (into brain tissue), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), or in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliar, intrabronchial, intrabursal, intracartilaginous (within a cartilage), intracaudal (within the cauda equine), intracisternal (within the cisterna magna cerebellomedularis), intracorneal (within the cornea), dental intracoronal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasmal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, pendural, perineural, penodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photophoresis and spinal.

The invention provides methods of treating and/or preventing a disease or disorder in a subject comprising administering to the subject an AAV particle described herein. The administration may be at a prophylactically effective dose such as, but not limited to, from about 1 ug/mL to about 500 ug/mL of expressed polypeptide or 1×10e4 to 1×10e16 VG/mL from the pharmaceutical composition. The pharmaceutical composition may be administered at least once. The pharmaceutical composition may be administered daily, weekly, monthly or yearly. The pharmaceutical composition may be co-administered as part of a combination therapy.

The invention provides methods of producing an antibody in a subject by administering the AAV particles described herein, where the antibody is not a virus neutralizing antibody.

The invention provides methods of producing an antibody in a subject by administering the AAV particles described herein, where the antibody is not an HIV or HCV virus neutralizing antibody.

BRIEF DESCRIPTION OF THE DRAWINGS

The foregoing and other objects, features and advantages will be apparent from the following description of particular embodiments of the invention, as illustrated in the accompanying drawings. The drawings are not necessarily to scale, emphasis instead being placed upon illustrating the principles of various embodiments of the invention.

FIG. 3 is a schematic of payload regions FIG. 3 discloses SEQ ID NO: 9221.

DETAILED DESCRIPTION OF THE INVENTION

I. Compositions of the Invention

Figure 1:
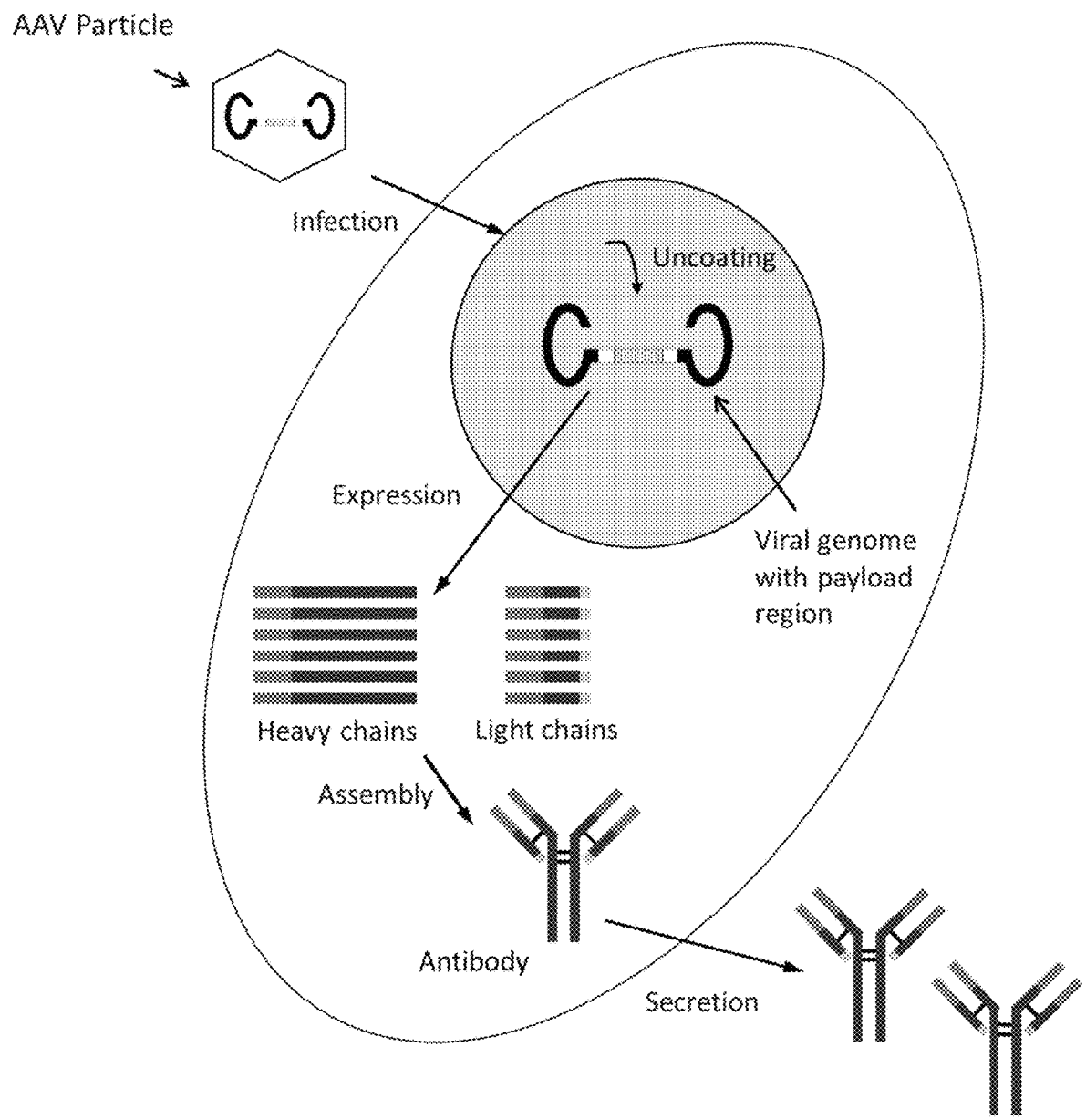
FIG. 1 is a schematic of vectored antibody delivery.

According to the present invention, compositions for delivering functional antibodies and/or antibody-based compositions by adeno-associated viruses (AAVs) are provided. AAV particles of the invention may be provided via any of several routes of administration, to a cell, tissue, organ, or organism min vivo, ex vivo or in vitro.

As used herein, an "AAV particle" is a virus which comprises a viral genome with at least one payload region and at least one inverted terminal repeat (ITR) region.

As used herein. "viral genome" or "vector genome" refers to the nucleic acid sequence(s) encapsulated in an AAV particle. Viral genomes comprise at least one payload region encoding polypeptides of the invention, e.g., antibodies, antibody-based compositions or fragments thereof.

As used herein, a "payload" or "payload region" is any nucleic acid molecule which encodes one or more polypeptides of the invention. At a minimum, a payload region comprises nucleic acid sequences that encode an antibody, an antibody-based composition, or a fragment thereof, but may also optionally comprise one or more functional or regulatory elements to facilitate transcriptional expression and/or polypeptide translation.

The nucleic acid sequences and polypeptides disclosed herein may be engineered to contain modular elements and/or sequence motifs assembled to enable expression of the antibodies or antibody-based compositions of the invention. In some embodiments, the nucleic acid sequence comprising the payload region may comprise one or more of a promoter region, an intron, a Kozak sequence, an enhancer or a poly adenylation sequence. Payload regions of the invention typically encode antibodies or antibody based compositions, which may include an antibody heavy chain domain, an antibody light chain domain, both antibody heavy and light chain domains, or fragments of the foregoing in combination with each other or in combination with other polypeptide moieties. In some cases, payload regions may also encode one or more linkers or joining regions between antibody heavy and light chain domains or fragments. The order of expression, structural position, or concatemer count (heavy chain, light chain, or linker) may be different within or among different payload regions. The identity, position and number of linkers expressed by payload regions may also vary.

The payload regions of the invention may be delivered to one or more target cells, tissues, organs or organisms within the viral genome of an AAV particle.

Adeno-Associated Viruses (AAVs) and AAV Particles

Viruses of the Parvoviridae family are small non-enveloped icosahedral capsid viruses characterized by a single stranded DNA genome. Parvovindae family viruses consist of two subfamilies: Parovirinae, which infect vertebrates, and Densovinnae, which infect invertebrates. Due to its relatively simple structure, easily manipulated using standard molecular biology techniques, this virus family is useful as a biological tool. The genome of the virus may be modified to contain a minimum of components for the assembly of a functional recombinant virus, or viral particle, which is loaded with or engineered to express or deliver a desired payload, which may be delivered to a target cell, tissue, organ, or organism.

The parvoviruses and other members of the Parvoviridae family are generally described in Kenneth I. Berns, "Parvoviridae: The Viruses and Their Replication," Chapter 69 in FIELDS VIROLOGY (3d Ed. 1996), the contents of which are incorporated by reference in their entirety.

The Parvoviridae family comprises the Dependovirus genus which includes adeno-associated viruses (AAV) capable of replication in vertebrate hosts including, but not limited to, human, primate, bovine, canine, equine, and ovine species.

The AAV vector genome is a linear, single-stranded DNA (ssDNA) molecule approximately 5,000 nucleotides (nt) in length. The AAV viral genome can comprise a payload region and at least one inverted terminal repeat (ITR) or ITR region. ITRs traditionally flank the coding nucleotide sequences for the non-structural proteins (encoded by Rep genes) and the structural proteins (encoded by capsid genes or Cap genes). While not wishing to be bound by theory, an AAV viral genome typically comprises two ITR sequences. The AAV vector genome comprises a characteristic T-shaped hairpin structure defined by the self-complementary terminal 145 nt of the 5' and 3' ends of the ssDNA which form an energetically stable double stranded region. The double stranded hairpin structures comprise multiple functions including, but not limited to, acting as an origin for DNA replication by functioning as primers for the endogenous DNA polymerase complex of the host viral replication cell.

In addition to the encoded heterologous payload, AAV vectors may comprise the viral genome, in whole or in part, of any naturally occurring and/or recombinant AAV serotype nucleotide sequence or variant. AAV variants may have sequences of significant homology at the nucleic acid (genome or capsid) and amino acid levels (capsids), to produce constructs which are generally physical and functional equivalents, replicate by similar mechanisms, and assemble by similar mechanisms. Chiorini et al., J. Vir. 71: 6823-33 (1997); Srivastava et al., J. Vir. 45:555-64 (1983), Chiorini et al., J. Vir. 73:1309-1319 (1999); Rutledge et al., J. Vir. 72:309-319 (1998); and Wu et al., J. Vir. 74: 8635-47 (2000), the contents of each of which are incorporated herein by reference in their entirety.

In one embodiment, AAV particles of the present invention are recombinant AAV viral vectors which are replication defective, lacking sequences encoding functional Rep and Cap proteins within their viral genome. These defective AAV vectors may lack most or all parental coding sequences and essentially carry only one or two AAV ITR sequences and the nucleic acid of interest for delivery to a cell, a tissue, an organ or an organism.

In one embodiment, the viral genome of the AAV particles of the present invention comprise at least one control element which provides for the replication, transcription and translation of a coding sequence encoded therein. Not all of the control elements need always be present as long as the coding sequence is capable of being replicated, transcribed and/or translated in an appropriate host cell. Non-limiting examples of expression control elements include sequences for transcription initiation and/or termination, promoter and/or enhancer sequences, efficient RNA processing signals such as splicing and polyadenylation signals, sequences that stabilize cytoplasmic mRNA, sequences that enhance translation efficacy (e.g., Kozak consensus sequence), sequences that enhance protein stability, and/or sequences that enhance protein processing and/or secretion.

According to the present invention. AAV particles for use in therapeutics and/or diagnostics comprise a virus that has been distilled or reduced to the minimum components necessary for transduction of a nucleic acid payload or cargo of interest. In this manner, AAV particles are engineered as vehicles for specific delivery while lacking the deleterious replication and/or integration features found in wild-type viruses.

AAV vectors of the present invention may be produced recombinantly and may be based on adeno-associated virus (AAV) parent or reference sequences. As used herein, a "vector" is any molecule or moiety which transports, transduces or otherwise acts as a carrier of a heterologous molecule such as the nucleic acids described herein.

In addition to single stranded AAV viral genomes (e.g., ssAAVs), the present invention also provides for self-complementary AAV (scAAVs) viral genomes scAAV vector genomes contain DNA strands which anneal together to form double stranded DNA. By skipping second strand synthesis, scAAVs allow for rapid expression in the cell.

In one embodiment, the AAV particle of the present invention is an scAAV.

In one embodiment, the AAV particle of the present invention is an ssAAV.

Methods for producing and/or modifying AAV particles are disclosed in the art such as pseudotyped AAV vectors (PCT Patent Publication Nos. WO200028004; WO200123001; WO2004112727; WO 2005005610 and WO2005072364, the content of each of which is incorporated herein by reference in its entirety).

AAV particles may be modified to enhance the efficiency of delivery. Such modified AAV particles can be packaged efficiently and be used to successfully infect the target cells at high frequency and with minimal toxicity. In some embodiments, the capsids of the AAV particles are engineered according to the methods described in US Publication Number US 20130195801, the contents of which are incorporated herein by reference in their entirety.

In one embodiment, the AAV particles comprising a payload region encoding the polypeptides of the invention may be introduced into mammalian cells.

AAV Serotypes

AAV particles of the present invention may comprise or be derived from any natural or recombinant AAV serotype. According to the present invention, the AAV particles may utilize or be based on a serotype selected from any of the following AAV1, AAV2, AAV2G9, AAV3, AAV3a, AAV3b, AAV3-3, AAV4, AAV4-4, AAV5, AAV6, AAV6.1, AAV6.2, AAV6.1.2, AAV7, AAV7.2, AAV8, AAV9, AAV9.11, AAV9.13, AAV9.16, AAV9.24, AAV9.45, AAV9.47, AAV9.61, AAV9.68, AAV9.84, AAV9.9, AAV10, AAV11, AAV12, AAV16.3, AAV24.1, AAV27.3, AAV42.12, AAV42-1b, AAV42-2, AAV42-3a, AAV42-3b, AAV42-4, AAV42-5a, AAV42-5b, AAV42-6b, AAV42-8, AAV42-10, AAV42-11, AAV42-12, AAV42-13, AAV42-15, AAV42-aa, AAV43-1, AAV43-12, AAV43-20, AAV43-21, AAV43-23, AAV43-25, AAV43-5, AAV44.1, AAV44.2, AAV44.5, AAV223.1, AAV223.2, AAV223.4, AAV223.5, AAV223.6, AAV223.7, AAV1-7/rh.48, AAV1-8/rh.49, AAV2-15/rh.62, AAV2-3/rh.61, AAV2-4/rh.50, AAV2-5/rh.51, AAV3.1/hu.6, AAV3.1/hu.9, AAV3-9/rh.52, AAV3-11/rh.53, AAV4-8/r11.64, AAV4-9/rh.54, AAV4-19/rh.55, AAV5-3/rh.57, AAV5-22/rh.58, AAV7.3/hu.7, AAV16.8/hu.10, AAV16.12/hu.11, AAV29.3/bb.1, AAV29.5/bb.2, AAV106.1/hu.37, AAV114.3/hu.40, AAV127.2/hu.41, AAV127.5/hu.42, AAV128.3/hu.44, AAV130.4/hu.48, AAV145.1/hu.53, AAV145.5/hu.54, AAV145.6/hu.55, AAV161.10/hu.60, AAV161.6/hu.61, AAV33.12/hu.17, AAV33.4/hu.15, AAV33.8/hu.16, AAV52/hu.19, AAV52.1/hu.20, AAV58.2/hu.25, AAVA3.3, AAVA3.4, AAVA3.5, AAVA3.7, AAVC1, AAVC2, AAVC5, AAV-DJ, AAV-DJ8, AAVF3, AAVF5, AAVH2, AAVrh.72, AAVhu.8, AAVrh.68, AAVrh.70, AAVpi.1, AAVpi.3, AAVpi.2, AAVrh.60, AAVrh.44, AAVrh.65, AAVrh.55, AAVrh.47, AAVrh.69, AAVrh.45, AAVrh.59, AAVhu.12, AAVH6, AAVLK03, AAVH-1/hu.1, AAVH-5/hu.3, AAVLG-10/rh.40, AAVLG-4/rh.38, AAVLG-9/hu.39, AAVN721-8/rh.43, AAVCh.5, AAVCh.5Ra, AAVcy.2, AAVcy.3, AAVcy.4, AAVcy.5, AAVCy.5R1, AAVCy.5R2, AAVCy.5R3, AAVCy.5R4, AAVcy.6, AAVhu.1, AAVhu.2, AAVhu.3, AAVhu.4, AAVhu.5, AAVhu.6, AAVhu.7, AAVhu.9, AAVhu.10, AAVhu.11, AAVhu.13, AAVhu.15, AAVhu.16, AAVhu.17, AAVhu.18, AAVhu.20, AAVhu.21, AAVhu.22, AAVhu.23.2, AAVhu.24, AAVhu.25, AAVhu.27, AAVhu.28, AAVhu.29, AAVhu.29R, AAVhu.31, AAVhu.32, AAVhu.34, AAVhu.35, AAVhu.37, AAVhu.39, AAVhu.40, AAVhu.41, AAVhu.42, AAVhu.43, AAVhu.44, AAVhu.44R1, AAVhu44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.51, AAVhu.52, AAVhu.54, AAVhu.55, AAVhu.56, AAVhu.57, AAVhu.58, AAVhu.60, AAVhu.61, AAVhu.63, AAVhu.64, AAVhu.66, AAVhu.67, AAVhu.14/9, AAVhu.t 19, AAVrh.2, AAVrh.2R, AAVrh.8, AAVrh.8R, AAVrh.10, AAVrh.12, AAVrh.13, AAVrh.13R, AAVrh.14, AAVrh.17, AAVrh.18, AAVrh.19, AAVrh.20, AAVrh.21, AAVrh.22, AAVrh.23, AAVrh.24, AAVrh.25, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.46, AAVrh.48, AAVrh.48.1, AAVrh.48.1.2, AAVrh.48.2, AAVrh.49, AAVrh.51, AAVrh.52, AAVrh.53, AAVrh.54. AAVrh.56, AAVrh.57, AAVrh.58, AAVrh.61, AAVrh.64, AAVrh.64R1, AAVrh.64R2, AAVrh.67, AAVrh.73, AAVrh.74, AAVrh8R, AAVrh8R A586R mutant, AAVrh8R R533A mutant, AAAV, BAAV, caprine AAV, bovine AAV, AAVhE1.1, AAVhEr1.5, AAVhER1.14, AAVhEr1.8, AAVhEr1.16, AAVhEr1.18, AAVhEr1.35, AAVhEr1.7, AAVhEr1.36, AAVhEr2.29, AAVhEr2.4, AAVhEr2.16, AAVhEr2.30, AAVhEr2.31, AAVhEr2.36, AAVhER1.23, AAVhEr3.1, AAV2.5T, AAV-PAEC, AAV-LK01, AAV-LK02, AAV-1LK03, AAV-LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK16, AAV-LK17, AAV-LK18, AAV-LK19, AAV-PAEC2, AAV-PAEC4, AAV-PAEC6, AAV-PAEC7, AAV-PAEC8, AAV-PAEC11, AAV-PAEC12, AAV-2-pre-mniRNA-101, AAV-8h, AAV-8b, AAV-h, AAV-b, AAV SM 10-2, AAV Shuffle 100-1, AAV Shuffle 100-3, AAV Shuffle 100-7, AAV Shuffle 10-2, AAV Shuffle 10-6, AAV Shuffle 10-8, AAV Shuffle 100-2, AAV SM 10-1, AAV SM 10-8, AAV SM 100-3, AAV SM 100-10, BNP61 AAV, BNP62 AAV, BNP63 AAV, AAVrh.50, AAVrh.43, AAVrh.62, AAVrh.48, AAVhu.19, AAVhu.11, AAVhu.53, AAV4-8/rh.64, AAVLG-9/hu.39, AAV54.5/hu.23, AAV54.2/hu.22, AAV54.7/hu.24, AAV54.1/hu.21, AAV54.4R/hu.27, AAV46.2/hu.28, AAV46.6/hu.29, AAV128.1/hu.43, true type AAV (ttAAV), UPENN AAV10, Japanese AAV10 serotypes, AAV CBr-7.1, AAV CBr-7.10, AAV CBr-7.2, AAV CBr-7.3, AAV CBr-7.4, AAV CBr-7.5, AAV CBr-7.7, AAV CBr-7.8, AAV CBr-B7.3, AAV CBr-B7.4, AAV CBr-E1, AAV CBr-E2, AAV CBr-E3, AAV CBr-E4, AAV CBr-E5, AAV CBr-e5, AAV CBr-E6, AAV CBr-E7, AAV CBr-E8, AAV CHt-1, AAV CHt-2, AAV CHt-3, AAV CHt-6.1, AAV CHt-6.10, AAV CHt-6.5, AAV CHt-6.6, AAV CHt-6.7, AAV CHt-6.8, AAV CHt-P1, AAV CHt-P2, AAV CHt-P5, AAV CHt-P6, AAV CHt-P8, AAV CHt-P9, AAV CKd-1, AAV CKd-10, AAV CKd-2, AAV CKd-3, AAV CKd-4, AAV CKd-6, AAV CKd-7, AAV CKd-8, AAV CKd-B1, AAV CKd-B2, AAV CKd-B3, AAV CKd-B4, AAV CKd-B5, AAV CKd-B6, AAV Ckd-B7, AAV Ckd-B8, AAV CKd-H1, AAV CKd-H2, AAV CKd-H3, AAV CKd-H4, AAV CKd-H5, AAV CKd-H6, AAV CKd-N3, AAV CKd-N4, AAV CKd-N9, AAV CLg-F1, AAV CLg-F2, AAV CLg-F3, AAV CLg-F4, AAV CLg-F5, AAV CLg-F6, AAV CLg-F7, AAV CLg-F8, AAV CLv-1, AAV CLv1-1, AAV Clv1-10, AAV CLv1-2, AAV CLv-12, AAV CLv1-3, AAV CLv-13, AAV CLv1-4, AAV Clv1-7, AAV Clv1-8, AAV Clv1-9, AAV CLv-2, AAV CLv-3, AAV CLv-4, AAV CLv-6, AAV CLv-8, AAV CLv-D1, AAV CLv-D2, AAV CLv-D3, AAV CLv-D4, AAV Clv-D5, AAV CLv-D6, AAV CLv-D7, AAV CLv-D8, AAV CL-E1, AAV CL-K1, AAV CLv-K3, AAV CLv-K6, AAV CLv-L4, AAV CLv-L5, AAV CLv-L6, AAV CLv-M1, AAV CLv-M11, AAV CLv-M2, AAV CLv-M5, AAV CLv-M6, AAV CLv-M7, AAV CLv-M8, AAV CLv-M9, AAV CLv-R1, AAV CLv-R2, AAV CLv-R3, AAV CLv-R4, AAV CLv-R5, AAV CLv-R6, AAV CLv-R7, AAV CLv-R8, AAV CLv-R9, AAV CSp-1, AAV CSp-10, AAV CSp-1, AAV CSp-2, AAV CSp-3, AAV CSp-4, AAV CSp-6, AAV CSp-7, AAV CSp-8, AAV CSp-8.10, AAV CSp-8.2, AAV CSp-8.4, AAV CSp-8.5, AAV CSp-8.6, AAV CSp-8.7, AAV CSp-8.8, AAV CSp-8.9, AAV CSp-9, AAV.hu.48R3, AAV.VR-355, AAV3B, AAV4, AAV5, AAVF1/HSC1, AAVF11/HSC11, AAVF12/HSC12, AAVF13/HSC13, AAVF14/HSC14, AAVF15/HSC15, AAVF16/HSC16, AAVF17/HSC17, AAVF2/HSC2, AAVF3/HSC3, AAVF4/HSC4, AAVF5/HSC5, AAVF6/HSC6, AAVF7/HSC7, AAVF8/HSC8, AAVF9/HSC9, PHP.B. PHP.A, G2B-26, G2B-13, TH1.1-32 and/or TH1.1-35 and variants thereof.

In some embodiments, the AAV serotype may be, or have, a sequence as described in United States Publication No. US20030138772, the contents of which are herein incorporated by reference in their entirety, such as, but not limited to, AAV1 (SEQ ID NO: 6 and 64 of US20030138772), AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO-114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772), AAV11 (SEQ ID NO-118 of US20030138772), AAV12 (SEQ ID NO: 119 of US20030138772), AAVrh10 (amino acids 1 to 738 of SEQ ID NO: 81 of US20030138772), AAV16.3 (US20030138772 SEQ ID NO. 10), AAV29.3/bb.1 (US20030138772 SEQ ID NO: 11), AAV29.4 (US20030138772 SEQ ID NO:12), AAV29.5/bb.2 (US20030138772 SEQ ID NO: 13), AAV1.3 (US20030138772 SEQ ID NO: 14), AAV13.3 (US20030138772 SEQ ID NO: 15), AAV24.1 (US20030138772 SEQ ID NO: 16), AAV27.3 (US20030138772 SEQ ID NO: 17), AAV7.2 (US20030138772 SEQ ID NO: 18), AAVC1 (US20030138772 SEQ ID NO: 19), AAVC3 (US20030138772 SEQ ID NO: 20), AAVC5 (US20030138772 SEQ ID NO: 21), AAVF1 (US20030138772 SEQ ID NO: 22), AAVF3 (US20030138772 SEQ ID NO: 23), AAV F5 (US20030138772 SEQ ID NO: 24), AAVH6 (US20030138772 SEQ ID NO: 25), AAVH2 (US20030138772 SEQ ID NO: 26), AAV42-8 (US20030138772 SEQ ID NO: 27), AAV42-15 (US20030138772 SEQ ID NO: 28), AAV42-5b (US20030138772 SEQ ID NO: 29), AAV42-1b (US20030138772 SEQ ID NO: 30), AAV42-13 (US20030138772 SEQ ID NO: 31), AAV42-3a (US20030138772 SEQ ID NO: 32), AAV42-4 (US20013138772 SEQ ID NO: 33), AAV42-5a (US20030138772 SEQ ID NO: 34), AAV42-10 (US20030138772 SEQ ID NO: 35), AAV42-3b (US20030138772 SEQ ID NO: 36), AAV42-11 (US20030138772 SEQ ID NO: 37), AAV42-6b (US20030138772 SEQ ID NO: 38), AAV43-1 (US20030138772 SEQ ID NO: 39), AAV43-5 (US20030138772 SEQ ID NO: 40), AAV43-12 (US20030138772 SEQ ID NO: 41), AAV43-20 (US20030138772 SEQ ID NO: 42), AAV43-21 (US20030138772 SEQ ID NO: 43), AAV43-23 (US20030138772 SEQ ID NO: 44), AAV43-25 (US20030138772 SEQ ID NO: 45), AAV44.1 (US20030138772 SEQ ID NO: 46), AAV44.5 (US20030138772 SEQ ID NO: 47), AAV223.1 (US20030138772 SEQ ID NO: 48), AAV223.2 (US20030138772 SEQ ID NO: 49), AAV223.4 (US20030138772 SEQ ID NO: 50), AAV223.5 (US20030138772 SEQ ID NO: 51), AAV223.6 (US20030138772 SEQ ID NO: 52), AAV223.7 (US20030138772 SEQ ID NO: 53), AAVA3.4 (US20030138772 SEQ ID NO: 54), AAVA3.5 (US20030138772 SEQ ID NO: 55), AAVA3.7 (US20030138772 SEQ ID NO: 56), AAVA3.3 (US20030138772 SEQ ID NO: 57), AAV42.12 (US20030138772 SEQ ID NO: 58), AAV44.2 (US20030138772 SEQ ID NO: 59), AAV42-2 (US20030138772 SEQ ID NO: 9), or variants thereof.

In some embodiments, the AAV serotype may be, or have, a sequence as described in United States Publication No. US20150159173, the contents of which are herein incorporated by reference in their entirety, such as, but not limited to, AAV2 (SEQ ID NO: 7 and 23 of US20150159173), rh20 (SEQ ID NO: 1 of US20150159173), rh32/33 (SEQ ID NO: 2 of US20150159173), rh39 (SEQ ID NO: 3, 20 and 36 of US20150159173), rh46 (SEQ ID NO: 4 and 22 of US20150159173), rh73 (SEQ ID NO: 5 of US20150159173), rh74 (SEQ ID NO: 6 of US20150159173), AAV6.1 (SEQ ID NO:29 of US20150159173), rh.8 (SEQ ID NO: 41 of US20150159173), rh.48.1 (SEQ ID NO: 44 of US20150159173), hu.44 (SEQ ID NO: 45 of US20150159173), hu.29 (SEQ ID NO: 42 of US20150159173), hu.48 (SEQ ID NO: 38 of US20150159173), rh54 (SEQ ID NO:49 of US20150159173), AAV2 (SEQ ID NO: 7 of US20150159173), cy.5 (SEQ ID NO: 8 and 24 of US20150159173), rh.10 (SEQ ID NO: 9 and 25 of US20150159173), rh.13 (SEQ ID NO: 10 and 26 of US20150159173), AAV1 (SEQ ID NO: 11 and 27 of US20150159173), AAV3 (SEQ ID NO: 12 and 28 of US20150159173), AAV6 (SEQ ID NO: 13 and 29 of US20150159173), AAV7 (SEQ ID NO: 14 and 30 of US20150159173), AAV8 (SEQ ID NO: 15 and 31 of US20150159173), hu.13 (SEQ ID NO: 16 and 32 of US20150159173), hu.26 (SEQ ID NO: 17 and 33 of US20150159173), hu.37 (SEQ ID NO: 18 and 34 of US20150159173), hu.53 (SEQ ID NO: 19 and 35 of US20150159173), rh.43 (SEQ ID NO: 21 and 37 of US20150159173), rh2 (SEQ ID NO: 39 of US20150159173), rh.37 (SEQ ID NO: 40 of US20150159173), rh.64 (SEQ ID NO: 43 of US20150159173), rh.48 (SEQ ID NO: 44 of US20150159173), ch 5 (SEQ ID NO: 46 of US20150159173), rh.67 (SEQ ID NO: 47 of US20150159173), rh.58 (SEQ ID NO: 48 of US20150159173), or variants thereof including, but not limited to Cy5R1, Cy5R2, Cy5R3, Cy5R4, rh.13R, rh.37R2, rh.2R, rh.8R, rh.48.1, rh.48.2, rh.48.12, hu.44R1, hu.44R2, hu.44R3, hu.29R, ch.5R1, rh64R1, rh64R2, AAV6.2, AAV6.1, AAV6.12, hu.48R1, hu.48R2, and hu.48R3.

In some embodiments, the AAV serotype may be, or have, a sequence as described in U.S. Pat. No. 7,198,951, the contents of which are herein incorporated by reference in their entirety, such as, but not limited to, AAV9 (SEQ ID NO: 1-3 of U.S. Pat. No. 7,198,951), AAV2 (SEQ ID NO: 4 of U.S. Pat. No. 7,198,951), AAV1 (SEQ ID NO: 5 of U.S. Pat. No. 7,198,951), AAV3 (SEQ ID NO: 6 of U.S. Pat. No. 7,198,951), and AAV8 (SEQ ID NO: 7 of U.S. Pat. No. 7,198,951).

In some embodiments, the AAV serotype may be, or have, a mutation in the AAV9 sequence as described by N Pulicherla et al. (Molecular Therapy 19(6): 1070-1078 (2011), herein incorporated by reference in its entirety), such as but not limited to, AAV9.9, AAV9.11, AAV9.13, AAV9.16, AAV9.24, AAV9.45, AAV9.47, AAV9.61, AAV9.68, AAV9.84.

In some embodiments, the AAV serotype may be, or have, a sequence as described in U.S. Pat. No. 6,156,303, the contents of which are herein incorporated by reference in their entirety, such as, but not limited to, AAV3B (SEQ ID NO: 1 and 10 of U.S. Pat. No. 6,156,303), AAV6 (SEQ ID NO: 2, 7 and 11 of U.S. Pat. No. 6,156,303), AAV2 (SEQ ID NO: 3 and 8 of U.S. Pat. No. 6,156,303), AAV3A (SEQ ID NO: 4 and 9, of U.S. Pat. No. 6,156,303), or derivatives thereof.

In some embodiments, the AAV serotype may be, or have, a sequence as described in United States Publication No US20140359799, the contents of which are herein incorporated by reference in their entirety, such as, but not limited to, AAV8 (SEQ ID NO:1 of US20140359799), AAVDJ (SEQ ID NO: 2 and 3 of US20140359799), or variants thereof.

In some embodiments, the serotype may be AAVDJ or a variant thereof, such as AAVDJ8 (or AAV-DJ8), as described by Grimm et al. (Journal of Virology 82(12): 5887-5911 (2008), herein incorporated by reference in its entirety). The amino acid sequence of AAVDJ8 may comprise two or more mutations in order to remove the heparin binding domain (HBD). As a non-limiting example, the AAV-DJ sequence described as SEQ ID NO: 1 in U.S. Pat. No. 7,588,772, the contents of which are herein incorporated by reference in their entirety, may comprise two mutations: (1) R587Q where arginine (R; Arg) at amino acid 587 is changed to glutamine (Q; Gln) and (2) R590T where arginine (R; Arg) at amino acid 590 is changed to threonine (T; Thr). As another non-limiting example, may comprise three mutations: (1) K406R where lysine (K; Lys) at amino acid 406 is changed to arginine (R; Arg), (2) R587Q where arginine (R; Arg) at amino acid 587 is changed to glutamine (Q; Gln) and (3) R590T where arginine (R; Arg) at amino acid 590 is changed to threonine (T; Thr).

In some embodiments, the AAV serotype may be, or have, a sequence of AAV4 as described in International Publication No. WO1998011244, the contents of which are herein incorporated by reference in their entirety, such as, but not limited to AAV4 (SEQ ID NO: 1-20 of WO1998011244).

In some embodiments, the AAV serotype may be, or have, a mutation in the AAV2 sequence to generate AAV2C9 as described in International Publication No. WO2014144229 and herein incorporated by reference in its entirety.

In some embodiments, the AAV serotype may be, or have, a sequence as described in International Publication No. WO2005033321, the contents of which are herein incorporated by reference in their entirety, such as, but not limited to AAV3-3 (SEQ ID NO:217 of WO2005033321), AAV1 (SEQ ID NO: 219 and 202 of WO2005033321), AAV106.1/hu.37 (SEQ ID No: 10 of WO2005033321), AAV114.3/hu.40 (SEQ ID No: 11 of WO2005033321), AAV127.2/hu.41 (SEQ ID NO:6 and 8 of WO2005033321), AAV128.3/hu.44 (SEQ ID No. 81 of WO2005033321), AAV130.4/hu.48 (SEQ ID NO: 78 of WO2005033321), AAV145.1/hu.53 (SEQ ID No: 176 and 177 of WO2005033321), AAV145.6/hu.56 (SEQ ID NO: 168 and 192 of WO2005033321), AAV16.12hu.11 (SEQ ID NO: 153 and 57 of WO2005033321), AAV16.8/hu.10 (SEQ ID NO: 156 and 56 of WO2005033321), AAV61.10hu.60 (SEQ ID No-170 of WO2005033321), AAV161.6/hu.61 (SEQ ID No: 174 of WO2005033321), AAV1-7/rh.48 (SEQ ID NO: 32 of WO2005033321), AAV1-8/rh.49 (SEQ ID NOs: 103 and 25 of WO2005033321), AAV2 (SEQ ID NO: 211 and 221 of WO2005033321), AAV2-15rh.62 (SEQ ID No: 33 and 114 of WO2005033321), AAV2-3/rh.61 (SEQ ID NO: 21 of WO2005033321), AAV2-4/rh.50 (SEQ ID No: 23 and 108 of WO2005033321), AAV2-5/rh.51 (SEQ ID NO: 104 and 22 of WO02005033321), AAV3.1/hu.6 (SEQ ID NO: 5 and 84 of WO20 (5033321), AAV3.4/hu.9 (SEQ ID NO: 155 and 58 of WO2005033321), AAV3-11/rh.53 (SEQ ID NO: 186 and 176 of WO2005033321), AAV3-3 (SEQ ID NO: 200 of WO2005033321), AAV33.12/hu.17 (SEQ ID NO:4 of WO2005033321), AAV33.4/hu.15 (SEQ ID No: 50 of WO2005033321), AAV33.8/hu.16 (SEQ ID No: 51 of WO2005033321), AAV3-9/rh.52 (SEQ ID NO: 96 and 18 of WO2005033321), AAV4-19/rh.55 (SEQ ID NO: 117 of WO2005033321), AAV4-4 (SEQ ID NO: 201 and 218 of WO2005033321), AAV4-9/rh.54 (SEQ ID NO: 116 of WO2005033321), AAV5 (SEQ ID NO: 199 and 216 of WO2005033321), AAV52.1/hu.20 (SEQ ID NO: 63 of WO2005033321), AAV52hu.19 (SEQ ID NO:133 of WO2005033321), AAV5-22/rh.58 (SEQ ID No: 27 of WO2005033321), AAV5-3/rh.57 (SEQ ID NO: 105 of WO2005033321), AAV5-3/rh.57 (SEQ ID No. 26 of WO2005033321), AAV58.2hu.25 (SEQ ID No: 49 of WO2005033321), AAV6 (SEQ ID NO: 203 and 220 of WO2005033321), AAV7 (SEQ ID NO: 222 and 213 of WO2005033321), AAV7.3/hu.7 (SEQ ID No: 55 of WO2005033321), AAV8 (SEQ ID NO: 223 and 214 of WO02005033321), AAVH-1/hu.1 (SEQ ID No: 46 of WO2005033321), AAVH-5/hu.3 (SEQ ID No: 44 of WO2005033321), AAVhu.11 (SEQ ID NO: 144 of WO2005033321), AAVhu.10 (SEQ ID NO: 156 of WO2005033321), AAVhu.1 (SEQ ID NO: 153 of WO20050333321), AAVhu.12 (WO2005033321 SEQ ID NO: 59), AAVhu.13 (SEQ ID NO: 129 of WO2005033321), AAVhu.14AAV9 (SEQ ID NO: 123 and 3 of WO2005033321), AAVhu.15 (SEQ ID NO: 147 of WO2005033321), AAVhu.16 (SEQ ID NO: 148 of WO02005033321), AAVhu.17 (SEQ ID NO: 83 of WO02005033321), AAVhu.18 (SEQ ID NO: 149 of WO2005033321), AAVhu.19 (SEQ ID NO: 133 of WO205033321), AAVhu.2 (SEQ ID NO:143 of WO2005033321), AAVhu.20 (SEQ ID NO:134 of WO2005033321), AAVhu.21 (SEQ ID NO: 135 of WO2005033321), AAVhu.22 (SEQ ID NO: 138 of WO2005033321), AAVhu.23.2 (SEQ ID NO: 137 of WO20050333321), AAVhu.24 (SEQ ID NO: 136 of WO2005033321), AAVhu.25 (SEQ ID NO: 146 of WO2005033321), AAVhu.27 (SEQ ID NO: 140 of WO2005033321), AAVhu.29 (SEQ ID NO: 132 of WO2005033321), AAVhu.3 (SEQ ID NO: 145 of WO2005033321), AAVhu.31 (SEQ ID NO: 121 of WO2005033321), AAVhu.32 (SEQ ID NO: 122 of WO2005033321), AAVhu.34 (SEQ ID NO. 125 of WO2005033321), AAVhu.35 (SEQ ID NO: 164 of WO2005033321), AAVhu.37 (SEQ ID NO: 88 of WO2005033321), AAVhu.39 (SEQ ID NO: 102 of WO2005033321), AAVhu.4 (SEQ ID NO: 141 of WO2005033321), AAVhu.40 (SEQ ID NO: 87 of WO2005033321), AAVhu.41 (SEQ ID NO: 91 of WO2005033321), AAVhu.42 (SEQ ID NO: 85 of WO2005033321), AAVhu.43 (SEQ ID NO:160 of WO2005033321), AAVhu.44 (SEQ ID NO-144 of WO2005033321), AAVhu.45 (SEQ ID NO: 127 of WO2005033321), AAVhu.46 (SEQ ID NO. 159 of WO2005033321), AAVhu.47 (SEQ ID NO: 128 of WO2005033321), AAVhu.48 (SEQ ID NO:157 of WO2005033321), AAVhu.49 (SEQ ID NO:189 of WO2005033321), AAVhu.51 (SEQ ID NO: 190 of WO2005033321), AAVhu.52 (SEQ ID NO: 191 of WO2005033321), AAVhu.53 (SEQ ID NO: 186 of WO2005033321), AAVhu.54 (SEQ ID NO: 188 of WO205033321), AAVhu.55 (SEQ ID NO: 187 of WO2005033321), AAVhu.56 (SEQ ID NO-192 of WO2005033321), AAVhu.57 (SEQ ID NO:193 of WO2005033321), AAVhu.58 (SEQ ID NO: 194 of WO2005033321), AAVhu.6 (SEQ ID NO: 84 of WO2005033321), AAVhu.60 (SEQ ID NO: 184 of WO2005033321), AAVhu.61 (SEQ ID NO: 185 of WO2005033321), AAVhu.63 (SEQ ID NO: 195 of WO2005033321), AAVhu.64 (SEQ ID NO: 196 of WO2005033321), AAVhu.66 (SEQ ID NO: 197 of WO2005033321), AAVhu.67 (SEQ ID NO: 198 of WO2005033321), AAVhu.7 (SEQ ID NO: 150 of WO2005033321), AAVhu.8 (WO2005033321 SEQ ID NO: 12), AAVhu.9 (SEQ ID NO: 155 of WO2005033321), AAVLG-10/rh.40 (SEQ ID No: 14 of WO2005033321), AAVLG-4/rh.38 (SEQ ID NO: 86 of WO2005033321), AAVLG-4/rh.38 (SEQ ID No: 7 of WO2005033321), AAVN721-8/rh.43 (SEQ ID NO:163 of WO2005033321), AAVN721-8/rh.43 (SEQ ID No: 43 of WO2005033321), AAVpi.1 (WO2005033321 SEQ ID NO: 28), AAVpi.2 (WO2005033321 SEQ ID NO: 30), AAVpi.3 (WO2005033321 SEQ ID NO: 29), AAVrh.38 (SEQ ID NO:

86 of WO2005033321), AAVrh.40 (SEQ ID NO: 92 of WO2005033321), AAVrh.43 (SEQ ID NO: 163 of WO2005033321), AAVrh.44 (WO2005033321 SEQ ID NO: 34), AAVrh.45 (WO2005033321 SEQ ID NO: 41), AAVrh.47 (WO2005033321 SEQ ID NO: 38), AAVrh.48 (SEQ ID NO: 115 of WO2005033321), AAVrh.49 (SEQ ID NO: 103 of WO2005033321), AAVrh.50 (SEQ ID NO: 108 of WO2005033321), AAVrh.51 (SEQ ID NO: 104 of WO2005033321), AAVrh.52 (SEQ ID NO: 96 of WO2005033321), AAVrh.53 (SEQ ID NO: 97 of WO2005033321), AAVrh.55 (WO2005033321 SEQ ID NO: 37), AAVrh.56 (SEQ ID NO: 152 of WO20050333321), AAVrh.57 (SEQ ID NO: 105 of WO2005033321), AAVrh.58 (SEQ ID NO: 106 of WO2005033321), AAVrh.59 (WO2005033321 SEQ ID NO: 42), AAVrh.60 (WO2005033321 SEQ ID NO: 31), AAVrh.61 (SEQ ID NO: 107 of WO2005033321), AAVrh.62 (SEQ ID NO: 114 of WO2005033321), AAVrh.64 (SEQ ID NO: 99 of WO2005033321), AAVrh.65 (WO2005033321 SEQ ID NO: 35), AAVrh.68 (WO2005033321 SEQ ID NO: 16), AAVrh.69 (WO2005033321 SEQ ID NO: 39), AAVrh.70 (WO2005033321 SEQ ID NO: 20), AAVrh.72 (WO2005033321 SEQ ID NO: 9), or variants thereof including, but not limited to, AAVcy.2, AAVcy.3, AAVcy.4, AAVcy.5, AAVcy.6, AAVrh.12, AAVrh.17, AAVrh.18, AAVrh.19, AAVrh.21, AAVrh.22, AAVrh.23, AAVrh.24, AAVrh.25, AAVrh.25/42 15, AAVrh.31, AAVrh.32, AAVrh.33, AAVrh.34, AAVrh.35, AAVrh.36, AAVrh.37, AAVrh.14. Non-limiting examples of variants include SEQ ID NO: 13, 15, 17, 19, 24, 36, 40, 45, 47, 48, 51-54, 60-62, 64-77, 79, 80, 82, 89, 90, 93-95, 98, 100, 101, 109-113, 118-120, 124, 126, 131, 139, 142, 151, 154, 158, 161, 162, 165-183, 202, 204-212, 215, 219, 224-236, of WO2005033321, the contents of which are herein incorporated by reference in their entirety.

In some embodiments, the AAV serotype may be, or have, a sequence as described in International Publication No. WO2015168666, the contents of which are herein incorporated by reference in their entirety, such as, but not limited to, AAVrh8R (SEQ ID NO: 9 of WO2015168666), AAVrh8R A586R mutant (SEQ ID NO: 10 of WO2015168666), AAVrh8R R533A mutant (SEQ ID NO: 11 of WO2015168666), or variants thereof.

In some embodiments, the AAV serotype may be, or have, a sequence as described in U.S. Pat. No. 9,233,131, the contents of which are herein incorporated by reference in their entirety, such as, but not limited to, AAVhE1.1 (SEQ ID NO:44 of U.S. Pat. No. 9,233,131), AAVhEr1.5 (SEQ ID NO:45 of U.S. Pat. No. 9,233,131), AAVhER1.14 (SEQ ID NO:46 of U.S. Pat. No. 9,233,131), AAVhEr1.8 (SEQ ID NO:47 of U.S. Pat. No. 9,233,131), AAVhEr1.16 (SEQ ID NO:48 of U.S. Pat. No. 9,233,131), AAVhEr1.18 (SEQ ID NO:49 of U.S. Pat. No. 9,233,131), AAVhEr1.35 (SEQ ID NO:50 of U.S. Pat. No. 9,233,131), AAVhEr1.7 (SEQ ID NO:51 of U.S. Pat. No. 9,233,131), AAVhEr1.36 (SEQ ID NO:52 of U.S. Pat. No. 9,233,131), AAVhEr2.29 (SEQ ID NO:53 of U.S. Pat. No. 9,233,131), AAVhEr2.4 (SEQ ID NO:54 of U.S. Pat. No. 9,233,131), AAVhEr2.16 (SEQ ID NO:55 of U.S. Pat. No. 9,233,131), AAVhEr2.30 (SEQ ID NO:56 of U.S. Pat. No. 9,233,131), AAVhEr2.31 (SEQ ID NO:58 of U.S. Pat. No. 9,233,131), AAVhEr2.36 (SEQ ID NO:57 of U.S. Pat. No. 9,233,131), AAVhER1.23 (SEQ ID NO:53 of U.S. Pat. No. 9,233,131), AAVhEr3.1 (SEQ ID NO:59 of U.S. Pat. No. 9,233,131), AAV2.5T (SEQ ID NO:42 of U.S. Pat. No. 9,233,131), or variants thereof.

In some embodiments, the AAV serotype may be, or have, a sequence as described in United States Patent Publication No. US20150376607, the contents of which are herein incorporated by reference in their entirety, such as, but not limited to, AAV-PAEC (SEQ ID NO: 1 of US20150376607), AAV-LK01 (SEQ ID NO:2 of US20150376607), AAV-LK02 (SEQ ID NO:3 of US20150376607), AAV-LK03 (SEQ ID NO:4 of US20150376607), AAV-LK04 (SEQ ID NO:5 of US20150376607), AAV-LK05 (SEQ ID NO:6 of US20150376607), AAV-LK06 (SEQ ID NO:7 of US20150376607), AAV-LK07 (SEQ ID NO:8 of US20150376607), AAV-LK08 (SEQ ID NO:9 of US20150376607), AAV-LK09 (SEQ ID NO:10 of US20150376607), AAV-LK10 (SEQ ID NO: 11 of US20150376607), AAV-LK11 (SEQ ID NO: 12 of US20150376607), AAV-LK12 (SEQ ID NO: 13 of US20150376607), AAV-LK13 (SEQ ID NO:14 of US20150376607), AAV-LK14 (SEQ ID NO:15 of US20150376607), AAV-LK15 (SEQ ID NO:16 of US20150376607), AAV-LK16 (SEQ ID NO:17 of US20150376607), AAV-LK17 (SEQ ID NO:18 of US20150376607), AAV-LK8 (SEQ ID NO:19 of US20150376607), AAV-LK19 (SEQ ID NO:20 of US20150376607), AAV-PAEC2 (SEQ ID NO:21 of US20150376607), AAV-PAEC4 (SEQ ID NO:22 of US20150376607), AAV-PAEC6 (SEQ ID NO:23 of US20150376607), AAV-PAEC7 (SEQ ID NO:24 of US20150376607), AAV-PAEC8 (SEQ ID NO:25 of US20150376607), AAV-PAEC11 (SEQ ID NO:26 of US20150376607), AAV-PAEC12 (SEQ ID NO:27, of US20150376607), or variants thereof.

In some embodiments, the AAV serotype may be, or have, a sequence as described in U.S. Pat. No. 9,163,261, the contents of which are herein incorporated by reference in their entirety, such as, but not limited to, AAV-2-pre-miRNA-101 (SEQ ID NO: 1 U.S. Pat. No. 9,163,261), or variants thereof.

In some embodiments, the AAV serotype may be, or have, a sequence as described in United States Patent Publication No. US20150376240, the contents of which are herein incorporated by reference in their entirety, such as, but not limited to, AAV-8h (SEQ ID NO: 6 of US20150376240), AAV-8b (SEQ ID NO: 5 of US20150376240), AAV-h (SEQ ID NO: 2 of US20150376240), AAV-b (SEQ ID NO: 1 of US20150376240), or variants thereof.

In some embodiments, the AAV serotype may be, or have, a sequence as described in United States Patent Publication No. US20160017295, the contents of which are herein incorporated by reference in their entirety, such as, but not limited to, AAV SM 10-2 (SEQ ID NO: 22 of US20160017295), AAV Shuffle 100-1 (SEQ ID NO: 23 of US2016017295), AAV Shuffle 100-3 (SEQ ID NO: 24 of US20160017295), AAV Shuffle 100-7 (SEQ ID NO: 25 of US20160017295), AAV Shuffle 10-2 (SEQ ID NO: 34 of US20160017295), AAV Shuffle 10-6 (SEQ ID NO: 35 of US20160017295), AAV Shuffle 10-8 (SEQ ID NO: 36 of US20160017295), AAV Shuffle 100-2 (SEQ ID NO: 37 of US20160017295), AAV SM 10-1 (SEQ ID NO: 38 of US20160017295), AAV SM 10-8 (SEQ ID NO: 39 of US20160017295), AAV SM 100-3 (SEQ ID NO: 40 of US20160017295), AAV SM 100-10) (SEQ ID NO: 41 of US20160017295), or variants thereof.

In some embodiments, the AAV serotype may be, or have, a sequence as described in United States Patent Publication No. US20150238550, the contents of which are herein incorporated by reference in their entirety, such as, but not limited to, BNP61 AAV (SEQ ID NO: 1 of US20150238550), BNP62 AAV (SEQ ID NO: 3 of US20150238550), BNP63 AAV (SEQ ID NO: 4 of US20150238550), or variants thereof.

In some embodiments, the AAV serotype may be or may have a sequence as described in United States Patent Publication No. US20150315612, the contents of which are herein incorporated by reference in their entirety, such as, but not limited to, AAVrh.50 (SEQ ID NO: 108 of US20150315612), AAVrh.43 (SEQ ID NO: 163 of US20150315612), AAVrh.62 (SEQ ID NO. 114 of US20150315612), AAVrh.48 (SEQ ID NO: 115 of US20150315612), AAVhu.19 (SEQ ID NO:133 of US20150315612), AAVhu.11 (SEQ ID NO: 153 of US20150315612), AAVhu.53 (SEQ ID NO: 186 of US20150315612), AAV4-8/rh.64 (SEQ ID No: 15 of US20150315612), AAVLG-9/hu.39 (SEQ ID No: 24 of US20150315612), AAV54.5/hu.23 (SEQ ID No. 60 of US20150315612), AAV54.2/hu.22 (SEQ ID No. 67 of US20150315612), AAV54.7/hu.24 (SEQ ID No: 66 of US20150315612), AAV54.1/hu.21 (SEQ ID No: 65 of US20150315612), AAV54.4R/hu.27 (SEQ ID No: 64 of US20150315612), AAV46.2/hu.28 (SEQ ID No: 68 of US20150315612), AAV46.6hu.29 (SEQ ID No: 69 of US20150315612), AAV128.1/hu.43 (SEQ ID No: 80 of US20150315612), or variants thereof.

In some embodiments, the AAV serotype may be, or have, a sequence as described in International Publication No. WO2015121501, the contents of which are herein incorporated by reference in their entirety, such as, but not limited to, true type AAV (ttAAV) (SEQ ID NO: 2 of WO2015121501. "UPenn AAV10" (SEQ ID NO: 8 of WO2015121501), "Japanese AAV10" (SEQ ID NO: 9 of WO2015121501), or variants thereof.

According to the present invention, AAV capsid serotype selection or use may be from a variety of species. In one embodiment, the AAV may be an avian AAV (AAAV). The AAAV serotype may be, or have, a sequence as described in U.S. Pat. No. 9,238,800, the contents of which are herein incorporated by reference in their entirety, such as, but not limited to, AAAV (SEQ ID NO: 1, 2, 4, 6, 8, 10, 12, and 14 of U.S. Pat. No. 9,238,800), or variants thereof.

In one embodiment, the AAV may be a bovine AAV (BAAV). The BAAV serotype may be, or have, a sequence as described in U.S. Pat. No. 9,193,769, the contents of which are herein incorporated by reference in their entirety, such as, but not limited to, BAAV (SEQ ID NO: 1 and 6 of U.S. Pat. No. 9,193,769), or variants thereof. The BAAV serotype may be or have a sequence as described in U.S. Pat. No. 7,427,396, the contents of which are herein incorporated by reference in their entirety, such as, but not limited to, BAAV (SEQ ID NO: 5 and 6 of U.S. Pat. No. 7,427,396), or variants thereof.

In one embodiment, the AAV may be a caprine AAV. The caprine AAV serotype may be, or have, a sequence as described in U.S. Pat. No. 7,427,396, the contents of which are herein incorporated by reference in their entirety, such as, but not limited to, caprine AAV (SEQ ID NO: 3 of U.S. Pat. No. 7,427,396), or variants thereof.

In other embodiments, the AAV may be engineered as a hybrid AAV from two or more parental serotypes. In one embodiment, the AAV may be AAV2G9 which comprises sequences from AAV2 and AAV9. The AAV2G9 AAV serotype may be, or have, a sequence as described in United States Patent Publication No. US2016017005, the contents of which are herein incorporated by reference in its entirety.

In one embodiment, the AAV may be a serotype generated by the AAV9 capsid library with mutations in amino acids 390-627 (VP1 numbering) as described by Pulicherla et al. (Molecular Therapy 19(6):1070-1078 (2011), the contents of which are herein incorporated by reference in their entirety. The serotype and corresponding nucleotide and amino acid substitutions may be, but is not limited to, AAV9.1 (G1594C; D5321HI), AAV6.2 (T1418A and T1436X; V473D and 1479K), AAV9.3 (T1238A; F413Y), AAV9.4 (T1250C and A1617T; F417S), AAV9.5 (A1235G, A1314T, A1642G, C1760T; Q412R, T548A, A587V), AAV9.6 (T1231A; F411I), AAV9.9 (G1203A, G1785T; W595C), AAV9.10 (A1500G, T1676C; M559T), AAV9.11 (A1425T, A1702C, A1769T; T568P, Q590L), AAV9.13 (A1369C, A1720T; N457H, T574S), AAV9.14 (T1340A, T1362C, T1560C, G1713A; L447H), AAV9.16 (A1775T; Q592L), AAV9.24 (T1507C, T1521G; W503R), AAV9.26 (A1337G, A1769C; Y446C, Q590P), AAV9.33 (A1667C; D556A), AAV9.34 (A1534G, C1794T; N512D), AAV9.35 (A1289T, T1450, C1494T, A1515T, C1794A, G1816A; Q430L, Y484N, N98K, V6061), AAV9.40 (A1694T, E565V), AAV9.41 (A1348T, T1362C; T450S), AAV9.44 (A1684C, A1701T, A1737G; N562H, K567N), AAV9.45 (A1492T, C804T; N498Y, L602F), AAV9.46 (G1441C, T1525C, T1549G; G481R, W509R, L517V), 9.47 (G1241A, G1358A, A1669G, C1745T; S414N, G453D, K557E, T582I), AAV9.48 (C1445T, A1736T; P482L, Q579L), AAV9.50 (A1638T, C1683T, T1805A; Q546H, L602H), AAV9.53 (G1301A, A1405C, C1664T, G1811T; R134Q, S469R, A555V, G604V), AAV9.54 (C1531A, T1609A; L511I, L537M), AAV9.55 (T1605A; F535L), AAV9.58 (C1475T, C1579A; T492I, H527N), AAV.59 (T1336C; Y446H), AAV9.61 (A1493T; N4981), AAV9.64 (C1531A, A1617T; L511I), AAV9.65 (C1335T, T1530C, C1568A; A523D), AAV9.68 (C1510A; P504T), AAV9.80 (G1441A, G481R), AAV9.83 (C1402A, A1500T; P468T, E500D), AAV9.87 (T1464C, T1468C; S49(P), AAV9.90 (A1196T; Y399F), AAV9.91 (T1316G, A1583T, C1782G, T1806C; L439R, K5281), AAV9.93 (A1273G, A1421G, A1638C, C1712T, G1732A, A1744T, A1832T; S425G, Q474R, Q546H, P571L, G578R, T582S, D611V), AAV9.94 (A1675T; M559L) and AAV9.95 (T1605A; F535L).

In some embodiments, the AAV serotype may be, or have, a sequence as described in International Publication No. WO2016049230, the contents of which are herein incorporated by reference in their entirety, such as, but not limited to AAVF1/HSC1 (SEQ ID NO: 2 and 20 of WO2016049230), AAVF2/HSC2 (SEQ ID NO: 3 and 21 of WO2016049230), AAVF3/HSC3 (SEQ ID NO: 5 and 22 of WO20160(49230), AAVF4/HSC4 (SEQ ID NO: 6 and 23 of WO2016049230), AAVF5/HSC5 (SEQ ID NO: 11 and 25 of WO2016049230), AAVF6/HSC6 (SEQ ID NO: 7 and 24 of WO2016049230), AAVF7/HSC7 (SEQ ID NO: 8 and 27 of WO2016049230), AAVF8/HSC8 (SEQ ID NO: 9 and 28 of WO20160(49230), AAVF9/HSC9 (SEQ ID NO: 10 and 29 of WO2016049230), AAVF11/HSC11 (SEQ ID NO: 4 and 26 of WO2016049230), AAVF12/HSC12 (SEQ ID NO: 12 and 30) of WO2016049230), AAVF13/HSC13 (SEQ ID NO: 14 and 31 of WO2016049230), AAVF14/HSC14 (SEQ ID NO: 15 and 32 of WO2016049230), AAVF15/HSC15 (SEQ ID NO: 16 and 33 of WO2016049230), AAVF16/HSC16 (SEQ ID NO: 17 and 34 of WO2016049230), AAVF177/HSC17 (SEQ ID NO. 13 and 35 of WO2016049230), or variants or derivatives thereof.

In some embodiments, the AAV serotype may be, or have, a sequence as described in U.S. Pat. No. 8,734,809, the contents of which are herein incorporated by reference in their entirety, such as, but not limited to, AAV CBr-E1 (SEQ ID NO: 13 and 87 of U.S. Pat. No. 8,734,809), AAV CBr-E2 (SEQ ID NO: 14 and 88 of U.S. Pat. No. 8,734,809), AAV CBr-E3 (SEQ ID NO: 15 and 89 of U.S. Pat. No. 8,734,809), AAV CBr-E4 (SEQ ID NO: 16 and 90 of U.S. Pat. No. 8,734,809), AAV CBr-E5 (SEQ ID NO: 17 and 91 of U.S. Pat. No. 8,734,809), AAV CBr-e5 (SEQ ID NO: 18 and 92 of U.S. Pat. No. 8,734,809), AAV CBr-E6 (SEQ ID NO:19 and 93 of U.S. Pat. No. 8,734,809), AAV CBr-E7 (SEQ ID NO: 20 and 94 of U.S. Pat. No. 8,734,809), AAV CBr-E8 (SEQ ID NO: 21 and 95 of U.S. Pat. No. 8,734,809), AAV CLv-D1 (SEQ ID NO: 22 and 96 of U.S. Pat. No. 8,734,809), AAV CLv-D2 (SEQ ID NO: 23 and 97 of U.S. Pat. No. 8,734,809), AAV CLv-D3 (SEQ ID NO: 24 and 98 of U.S. Pat. No. 8,734,809), AAV CLv-D4 (SEQ ID NO: 25 and 99 of U.S. Pat. No. 8,734,809), AAV CLv-D5 (SEQ ID NO: 26 and 100 of U.S. Pat. No. 8,734,809), AAV CLv-D6 (SEQ ID NO: 27 and 101 of U.S. Pat. No. 8,734,809), AAV CLv-D7 (SEQ ID NO: 28 and 102 of U.S. Pat. No. 8,734,809), AAV CLv-D8 (SEQ ID NO: 29 and 103 of U.S. Pat. No. 8,734,809, AAV CLv-E1 (SEQ ID NO: 13 and 87 of U.S. Pat. No. 8,734,809), AAV CLv-R1 (SEQ ID NO: 30 and 104 of U.S. Pat. No. 8,734,809), AAV CLv-R2 (SEQ ID NO: 31 and 105 of U.S. Pat. No. 8,734,809), AAV CLv-R3 (SEQ ID NO: 32 and 106 of U.S. Pat. No. 8,734,809), AAV CLv-R4 (SEQ ID NO: 33 and 107 of U.S. Pat. No. 8,734,809), AAV CLv-R5 (SEQ ID NO: 34 and 108 of U.S. Pat. No. 8,734,809), AAV CLv-R6 (SEQ ID NO: 35 and 109 of U.S. Pat. No. 8,734,809), AAV CLv-R7 (SEQ ID NO: 36 and 110 of U.S. Pat. No. 8,734,809), AAV CLv-R8 (SEQ ID NO: 37 and 111 of U.S. Pat. No. 8,734,809), AAV CL-R9 (SEQ ID NO: 38 and 112 of U.S. Pat. No. 8,734,809), AAV CLg-F1 (SEQ ID NO: 39 and 113 of U.S. Pat. No. 8,734,809), AAV CLg-F2 (SEQ ID NO: 40 and 114 of U.S. Pat. No. 8,734,809), AAV CLg-F3 (SEQ ID NO: 41 and 115 of U.S. Pat. No. 8,734,809), AAV CLg-F4 (SEQ ID NO: 42 and 116 of U.S. Pat. No. 8,734,809), AAV CLg-F5 (SEQ ID NO: 43 and 117 of U.S. Pat. No. 8,734,809), AAV CLg-F6 (SEQ ID NO: 43 and 117 of U.S. Pat. No. 8,734,809), AAV CLg-F7 (SEQ ID NO: 44 and 118 of U.S. Pat. No. 8,734,809), AAV CLg-F8 (SEQ ID NO: 43 and 117 of U.S. Pat. No. 8,734,809), AAV CSp-1 (SEQ ID NO: 45 and 119 of U.S. Pat. No. 8,734,809), AAV CSp-10 (SEQ ID NO: 46 and 120 of U.S. Pat. No. 8,734,809), AAV CSp-11 (SEQ ID NO: 47 and 121 of U.S. Pat. No. 8,734,809), AAV CSp-2 (SEQ ID NO: 48 and 122 of U.S. Pat. No. 8,734,809), AAV CSp-3 (SEQ ID NO: 49 and 123 of U.S. Pat. No. 8,734,809), AAV CSp-4 (SEQ ID NO: 50 and 124 of U.S. Pat. No. 8,734,809), AAV CSp-6 (SEQ ID NO: 51 and 125 of U.S. Pat. No. 734,809), AAV CSp-7 (SEQ ID NO-52 and 126 of U.S. Pat. No. 8,734,809), AAV CSp-8 (SEQ ID NO: 53 and 127 of U.S. Pat. No. 8,734,809), AAV CSp-9 (SEQ ID NO: 54 and 128 of U.S. Pat. No. 8,734,809), AAV CHt-2 (SEQ ID NO: 55 and 129 of U.S. Pat. No. 8,734,809), AAV CHt-3 (SEQ ID NO: 56 and 130 of U.S. Pat. No. 8,734,809), AAV CKd-1 (SEQ ID NO: 57 and 131 of U.S. Pat. No. 8,734,809), AAV CKd-10 (SEQ ID NO: 58 and 132 of U.S. Pat. No. 8,734,809), AAV CKd-2 (SEQ ID NO: 59 and 133 of U.S. Pat. No. 8,734,809), AAV CKd-3 (SEQ ID NO: 60 and 134 of U.S. Pat. No. 8,734,809), AAV CKd-4 (SEQ ID NO: 61 and 135 of U.S. Pat. No. 8,734,809), AAV CKd-6 (SEQ ID NO: 62 and 136 of U.S. Pat. No. 8,734,809), AAV CKd-7 (SEQ ID NO: 63 and 137 of U.S. Pat. No. 8,734,809), AAV CKd-8 (SEQ ID NO: 64 and 138 of U.S. Pat. No. 8,734,809), AAV CLv-1 (SEQ ID NO: 35 and 139 of U.S. Pat. No. 8,734,809), AAV CLv-12 (SEQ ID NO: 66 and 140 of U.S. Pat. No. 8,734,809), AAV CLv-13 (SEQ ID NO: 67 and 141 of U.S. Pat. No. 8,734,809), AAV CLv-2 (SEQ ID NO: 68 and 142 of U.S. Pat. No. 8,734,809), AAV CLv-3 (SEQ ID NO: 69 and 143 of U.S. Pat. No. 8,734,809), AAV CLv-4 (SEQ ID NO: 70 and 144 of U.S. Pat. No. 8,734,809), AAV CLv-6 (SEQ ID NO: 71 and 145 of U.S. Pat. No. 8,734,809), AAV CLv-8 (SEQ ID NO: 72 and 146 of U.S. Pat. No. 8,734,809), AAV CKd-B1 (SEQ ID NO: 73 and 147 of U.S. Pat. No. 8,734,809), AAV CKd-B2 (SEQ ID NO: 74 and 148 of U.S. Pat. No. 8,734,809), AAV CKd-B3 (SEQ ID NO: 75 and 149 of U.S. Pat. No. 8,734,809), AAV CKd-B4 (SEQ ID NO: 76 and 150) of U.S. Pat. No. 8,734,809), AAV CKd-B5 (SEQ ID NO: 77 and 151 of U.S. Pat. No. 8,734,809), AAV CKd-B6 (SEQ ID NO: 78 and 152 of U.S. Pat. No. 8,734,809), AAV CKd-B7 (SEQ ID NO: 79 and 153 of U.S. Pat. No. 8,734,809), AAV CKd-B8 (SEQ ID NO: 80 and 154 of U.S. Pat. No. 8,734,809), AAV CKd-H1 (SEQ ID NO: 81 and 155 of U.S. Pat. No. 8,734,809), AAV CKd-H2 (SEQ ID NO: 82 and 156 of U.S. Pat. No. 8,734,809), AAV CKd-H3 (SEQ ID NO: 83 and 157 of U.S. Pat. No. 8,734,809), AAV CKd-H4 (SEQ ID NO: 84 and 158 of U.S. Pat. No. 8,734,809), AAV CKd-H5 (SEQ ID NO: 85 and 159 of U.S. Pat. No. 8,734,809), AAV CKd-H6 (SEQ ID NO: 77 and 151 of U.S. Pat. No. 8,734,809), AAV CHt-1 (SEQ ID NO: 86 and 160 of 8734809), AAV CLv1-1 (SEQ ID NO: 171 of U.S. Pat. No. 8,734,809), AAV CLv1-2 (SEQ ID NO: 172 of U.S. Pat. No. 8,734,809), AAV CLv1-3 (SEQ ID NO: 173 of U.S. Pat. No. 734,809), AAV CLv1-4 (SEQ ID NO: 174 of U.S. Pat. No. 8,734,809), AAV Clv1-7 (SEQ ID NO: 175 of U.S. Pat. No. 8,734,809), AAV Clv1-8 (SEQ ID NO: 176 of U.S. Pat. No. 8,734,809), AAV Clv1-9 (SEQ ID NO: 177 of U.S. Pat. No. 8,734,809), AAV Clv-10 (SEQ ID NO: 178 of U.S. Pat. No. 8,734,809), AAV.VR-355 (SEQ ID NO: 181 of U.S. Pat. No. 8,734,809), AAV.hu.48R3 (SEQ ID NO: 183 of U.S. Pat. No. 8,734,809), or variants or derivatives thereof.

In some embodiments, the AAV serotype may be, or have, a sequence as described in International Publication No. WO2016065001, the contents of which are herein incorporated by reference in their entirety, such as, but not limited to AAV CHt-P2 (SEQ ID NO: 1 and 51 of WO2016065001), AAV CHt-P5 (SEQ ID NO: 2 and 52 of WO2016065001), AAV CHt-P9 (SEQ ID NO: 3 and 53 of WO2016065001), AAV CBr-7.1 (SEQ ID NO: 4 and 54 of WO2016065001), AAV CBr-7.2 (SEQ ID NO: 5 and 55 of WO2016065001), AAV CBr-7.3 (SEQ ID NO: 6 and 56 of WO2016065001), AAV CBr-7.4 (SEQ ID NO: 7 and 57 of WO2016065001), AAV CBr-7.5 (SEQ ID NO: 8 and 58 of WO2016065001), AAV CBr-7.7 (SEQ ID NO: 9 and 59 of WO2016065001), AAV CBr-7.8 (SEQ ID NO: 10 and 60 of WO2016065001), AAV CBr-7.10 (SEQ ID NO: 11 and 61 of WO2016065001), AAV CKd-N3 (SEQ ID NO: 12 and 62 of WO2016065001), AAV CKd-N4 (SEQ ID NO: 13 and 63 of WO2016065001), AAV CKd-N9 (SEQ ID NO: 14 and 64 of WO2016065001), AAV CLv-L4 (SEQ ID NO: 15 and 65 of WO2016065001), AAV CLv-L5 (SEQ ID NO: 16 and 66 of WO2016065001), AAV CLv-L6 (SEQ ID NO: 17 and 67 of WO2016065001), AAV CLv-K1 (SEQ ID NO: 18 and 68 of WO2016065001), AAV CLv-K3 (SEQ ID NO: 19 and 69 of WO2016065001), AAV CLv-K6 (SEQ ID NO: 20 and 70 of WO2016065001), AAV CLv-M (SEQ ID NO: 21 and 71 of WO2016065001), AAV CLv-M11 (SEQ ID NO: 22 and 72 of WO2016065001), AAV CLv-M2 (SEQ ID NO: 23 and 73 of WO2016065001), AAV CLv-M5 (SEQ ID NO: 24 and 74 of WO2016065001), AAV CLv-M6 (SEQ ID NO: 25 and 75 of WO2016065001), AAV CLv-M7 (SEQ ID NO: 26 and 76 of WO2016065001), AAV CLv-M8 (SEQ ID NO: 27 and 77 of WO2016065001), AAV CLv-M9 (SEQ ID NO: 28 and 78 of WO2016065001), AAV CHt-P1 (SEQ ID NO: 29 and 79 of WO2016065001), AAV CHt-P6 (SEQ ID NO: 30 and 80 of WO2016065001), AAV CHt-P8 (SEQ ID NO: 31 and 81 of WO2016065001), AAV CHt-6.1 (SEQ ID NO: 32 and 82 of WO2016065001), AAV CHt-6.10 (SEQ ID NO: 33 and 83 of WO2016065001), AAV CHt-6.5 (SEQ ID NO: 34 and 84 of WO2016065001), AAV CHt-6.6 (SEQ ID NO: 35 and 85 of WO2016065001), AAV CHt-6.7 (SEQ ID NO: 36 and 86 of WO2016065001), AAV CHt-6.8 (SEQ ID NO: 37 and 87 of WO2016065001), AAV CSp-8.10 (SEQ ID NO: 38 and 88 of WO2016065001), AAV CSp-8.2 (SEQ ID NO: 39 and 89 of WO2016065001), AAV CSp-8.4 (SEQ ID NO: 40 and 90 of WO2016065001), AAV CSp-8.5 (SEQ ID NO: 41 and 91 of WO2016065001), AAV CSp-8.6 (SEQ ID NO: 42 and 92 of WO2016065001), AAV CSp-8.7 (SEQ ID NO: 43 and 93 of WO2016065001), AAV CSp-8.8 (SEQ ID NO: 44 and 94 of WO2016065001), AAV CSp-8.9 (SEQ ID NO: 45 and 95 of WO2016065001), AAV CBr-B7.3 (SEQ ID NO: 46 and 96 of WO2016065001), AAV CBr-B7.4 (SEQ ID NO: 47 and 97 of WO2016065001), AAV3B (SEQ ID NO: 48 and 98 of WO2016065001), AAV4 (SEQ ID NO: 49 and 99 of WO2016065001), AAV5 (SEQ ID NO: 50 and 100 of WO2016065001), or variants or derivatives thereof.

In one embodiment, the AAV may be a serotype selected from any of those found in Table 1.

In one embodiment, the AAV may comprise a sequence, fragment or variant thereof, of the sequences in Table 1.

In one embodiment, the AAV may be encoded by a sequence, fragment or variant as described in Table 1.

TABLE 1

AAV Serotypes

| Serotype | SEQ ID NO | Reference Information |
|---|---|---|
| AAV1 | 1 | US20150159173 SEQ ID NO: 11, US2015 315612 SEQ ID NO: 202 |
| AAV1 | 2 | US20160017295 SEQ ID NO: 1US20030138772 SEQ ID NO: 64, US20150159173 SEQ ID NO: 27, US20150315612 SEQ ID NO: 219, US7198951 SEQ ID NO: 5 |
| AAV1 | 3 | US20030138772 SEQ ID NO: 6 |
| AAV1.3 | 4 | US20030138772 SEQ ID NO: 14 |
| AAV10 | 5 | US20030 38772 SEQ ID NO: 117 |
| AAV10 | 6 | WO20151501 SEQ ID NO: 9 |
| AAV10 | 7 | WO2015121501 SEQ ID NO: 8 |
| AAV11 | 8 | US20030138772 SEQ ID NO: 118 |
| AAV12 | 9 | US20030138772 SEQ ID NO: 119 |
| AAV2 | 10 | US20150159173 SEQ ID NO: 7, US20150315612 SEQ ID NO: 211 |
| AAV2 | 11 | US20030138772 SEQ ID NO: 70, US20150159173 SEQ ID NO: 23, US20150315612 SEQ ID NO: 221, US20160017295 SEQ ID NO: 2, US6156303 SEQ ID NO: 4, US7198951 SEQ ID NO: 4, WO2015121501 SEQ ID NO: 1 |
| AAV2 | 12 | US6156303 SEQ ID NO: 8 |
| AAV2 | 13 | US20030138772 SEQ ID NO: 7 |
| AAV2 | 14 | US6156303 SEQ ID NO: 3 |
| AAV2.5T | 15 | US9233131 SEQ ID NO: 42 |
| AAV223.10 | 16 | US20030138772 SEQ ID NO: 75 |
| AAV223.2 | 17 | US20030138772 SEQ ID NO: 49 |
| AAV223.2 | 18 | US20030138772 SEQ ID NO: 76 |
| AAV223.4 | 19 | US20030138772 SEQ ID NO: 50 |
| AAV223.4 | 20 | US20030138772 SEQ ID NO: 73 |
| AAV223.5 | 21 | US20030138772 SEQ ID NO: 51 |
| AAV223.5 | 22 | US20030138772 SEQ ID NO: 74 |
| AAV223.6 | 23 | US20030138772 SEQ ID NO: 52 |
| AAV223.6 | 24 | US20030138772 SEQ ID NO: 78 |
| AAV223.7 | 25 | US20030138772 SEQ ID NO: 53 |
| AAV223.7 | 26 | US20030138772 SEQ ID NO: 77 |
| AAV29.3 | 27 | US20030138772 SEQ ID NO: 82 |
| AAV29.4 | 28 | US20030138772 SEQ ID NO: 12 |
| AAV29.5 | 29 | US20030138772 SEQ ID NO: 83 |
| AAV29.5 (AAVbb.2) | 30 | US20030138772 SEQ ID NO: 13 |
| AAV3 | 31 | US20150159173 SEQ ID NO: 12 |
| AAV3 | 32 | US20030138772 SEQ ID NO: 71, US2015019173 SEQ ID NO: 28, US20160017295 SEQ ID NO: 3, US7198951 SEQ ID NO: 6 |
| AAV3 | 33 | US20030138772 SEQ ID NO: 8 |
| AAV3.3b | 34 | US20030138772 SEQ ID NO: 72 |
| AAV3-3 | 35 | US20150315612 SEQ ID NO: 200 |
| AAV3-3 | 36 | US20150315612 SEQ ID NO: 217 |
| AAV3a | 37 | US6156303 SEQ ID NO: 5 |
| AAV3a | 38 | US6156303 SEQ ID NO: 9 |
| AAV3b | 39 | US6156303 SEQ ID NO: 6 |
| AAV3b | 40 | US6156303 SEQ ID NO: 10 |
| AAV3b | 41 | US6156303 SEQ ID NO: 1 |
| AAV4 | 42 | US20140348794 SEQ ID NO: 17 |
| AAV4 | 43 | US20140348794 SEQ ID NO: 5 |
| AAV4 | 44 | US20140348794 SEQ ID NO: 3 |
| AAV4 | 45 | US20140348794 SEQ ID NO: 14 |
| AAV4 | 46 | US20140348794 SEQ ID NO: 15 |
| AAV4 | 47 | US20140348794 SEQ ID NO: 19 |
| AAV4 | 48 | US20140348794 SEQ ID NO: 12 |
| AAV4 | 49 | US20140348794 SEQ ID NO: 13 |
| AAV4 | 50 | US20140348794 SEQ ID NO: 7 |

TABLE 1-continued

AAV Serotypes

| Serotype | SEQ ID NO | Reference Information |
|---|---|---|
| AAV4 | 51 | US20140348794 SEQ ID NO: 8 |
| AAV4 | 52 | US20140348794 SEQ ID NO: 9 |
| AAV4 | 53 | US20140348794 SEQ ID NO: 2 |
| AAV4 | 54 | US20140348794 SEQ ID NO: 10 |
| AAV4 | 55 | US20140348794 SEQ ID NO: 11 |
| AAV4 | 56 | US20140348794 SEQ ID NO: 18 |
| AAV4 | 57 | US20030138772 SEQ ID NO: 63, US20160017295 SEQ ID NO: 4, US20140348794 SEQ ID NO: 4 |
| AAV4 | 58 | US20140348794 SEQ ID NO: 16 |
| AAV4 | 59 | US20140348794 SEQ ID NO: 20 |
| AAV4 | 60 | US20140348794 SEQ ID NO: 6 |
| AAV4 | 61 | US20140348794 SEQ ID NO: 1 |
| AAV42.2 | 62 | US20030138772 SEQ ID NO: 9 |
| AAV42.2 | 63 | US20030138772 SEQ ID NO: 102 |
| AAV42.3b | 64 | US20030138772 SEQ ID NO: 36 |
| AAV42.3B | 65 | US20030138772 SEQ ID NO: 107 |
| AAV42.4 | 66 | US20030138772 SEQ ID NO: 33 |
| AAV42.4 | 67 | US20030138772 SEQ ID NO: 88 |
| AAV42.8 | 68 | US20030138772 SEQ ID NO: 27 |
| AAV42.8 | 69 | US20030138772 SEQ ID NO: 85 |
| AAV43.1 | 70 | US20030138772 SEQ ID NO: 39 |
| AAV43.1 | 71 | US20030138772 SEQ ID NO: 92 |
| AAV43.12 | 72 | US20030138772 SEQ ID NO: 41 |
| AAV43.12 | 73 | US20030138772 SEQ ID NO: 93 |
| AAV43.20 | 74 | US20030138772 SEQ ID NO: 42 |
| AAV43.20 | 75 | US20030138772 SEQ ID NO: 99 |
| AAV43.21 | 76 | US20030138772 SEQ ID NO: 43 |
| AAV43.21 | 77 | US20030138772 SEQ ID NO: 96 |
| AAV43.23 | 78 | US20030138772 SEQ ID NO: 44 |
| AAV43.23 | 79 | US20030138772 SEQ ID NO: 98 |
| AAV43.25 | 80 | US20030138772 SEQ ID NO: 45 |
| AAV43.25 | 81 | US20030138772 SEQ ID NO: 97 |
| AAV43.5 | 82 | US20030138772 SEQ ID NO: 40 |
| AAV43.5 | 83 | US20030138772 SEQ ID NO: 94 |
| AAV4-4 | 84 | US20150315612 SEQ ID NO: 201 |
| AAV4-4 | 85 | US20150315612 SEQ ID NO: 218 |
| AAV44.1 | 86 | US20030138772 SEQ ID NO: 46 |
| AAV44.1 | 87 | US20030138772 SEQ ID NO: 79 |
| AAV44.5 | 88 | US20030138772 SEQ ID NO: 47 |
| AAV44.5 | 89 | US20030138772 SEQ ID NO: 80 |
| AAV4407 | 90 | US20150315612 SEQ ID NO: 90 |
| AAV5 | 91 | US7427396 SEQ ID NO: 1 |
| AAV5 | 92 | US20030138772 SEQ ID NO: 114 |
| AAV5 | 93 | US20160017295 SEQ ID NO: 5, US7427396 SEQ ID NO: 2, US2015035612 SEQ ID NO: 216 |
| AAV5 | 94 | US20150315612 SEQ ID NO: 199 |
| AAV6 | 95 | US20150159173 SEQ ID NO: 13 |
| AAV6 | 96 | US20030138772 SEQ ID NO: 65, US20150159173 SEQ ID NO: 29, US20160017295 SEQ ID NO: 6, US6156303 SEQ ID NO: 7 |
| AAV6 | 97 | US6156303 SEQ ID NO: 11 |
| AAV6 | 98 | US6156303 SEQ ID NO: 2 |
| AAV6 | 99 | US20150315612 SEQ ID NO: 203 |
| AAV6 | 100 | US20150315612 SEQ ID NO: 220 |
| AAV6.1 | 101 | US20150159173 |
| AAV6.12 | 102 | US20150159173 |
| AAV6.2 | 103 | US20150159173 |
| AAV7 | 104 | US20150159173 SEQ ID NO: 14 |
| AAV7 | 105 | US20150315612 SEQ ID NO: 183 |
| AAV7 | 106 | US20030138772 SEQ ID NO: 2, US20150159173 SEQ ID NO: 30, US20150315612 SEQ ID NO: 181, US20160017295 SEQ ID NO:7 |
| AAV7 | 107 | US20030138772 SEQ ID NO: 3 |
| AAV7 | 108 | US20030138772 SEQ ID NO: 1, US20150315612 SEQ ID NO: 180 |
| AAV7 | 109 | US20150315612 SEQ ID NO: 213 |
| AAV7 | 110 | US20150315612 SEQ ID NO: 222 |
| AAV8 | 111 | US20150159173 SEQ ID NO: 15 |
| AAV8 | 112 | US20150376240 SEQ ID NO: 7 |
| AAV8 | 113 | US20030138772 SEQ ID NO: 4, US20150315612 SEQ ID NO: 182 |
| AAV8 | 114 | US20030138772 SEQ ID NO: 95, US20140359799 SEQ ID NO: 1, US20150159173 SEQ ID NO: 31, US20160017295 SEQ ID NO: 8, US7198951 SEQ ID NO: 7, US20150315612 SEQ ID NO: 223 |
| AAV8 | 115 | US20150376240 SEQ ID NO: 8 |
| AAV8 | 116 | US20150315612 SEQ ID NO: 214 |
| AAV-8b | 117 | US20150376240 SEQ ID NO: 5 |
| AAV-8b | 118 | US20150376240 SEQ ID NO: 3 |
| AAV-8h | 119 | US20150376240 SEQ ID NO: 6 |
| AAV-8h | 120 | US20150376240 SEQ ID NO: 4 |

TABLE 1-continued

AAV Serotypes

| Serotype | SEQ ID NO | Reference Information |
|---|---|---|
| AAV9 | 121 | US20030138772 SEQ ID NO: 5 |
| AAV9 | 122 | US7198951 SEQ ID NO: 1 |
| AAV9 | 123 | US20160017295 SEQ ID NO: 9 |
| AAV9 | 124 | US20030138772 SEQ ID NO: 100, US7198951 SEQ ID NO: 2 |
| AAV9 | 125 | US7198951 SEQ ID NO: 3 |
| AAV9 (AAVhu.14) | 126 | US7906111 SEQ ID NO: 3; WO2015038958 SEQ ID NO: 11 |
| AAV9 (AAVhu.14) | 127 | US7906111 SEQ ID NO: 123; WO2015038958 SEQ ID NO: 2 |
| AAVA3.1 | 128 | US20030138772 SEQ ID NO: 120 |
| AAVA3.3 | 129 | US20030138772 SEQ ID NO: 57 |
| AAVA3.3 | 130 | US20030138772 SEQ ID NO: 66 |
| AAVA3.4 | 131 | US20030138772 SEQ ID NO: 54 |
| AAVA3.4 | 132 | US20030138772 SEQ ID NO: 68 |
| AAVA3.5 | 133 | US20030138772 SEQ ID NO: 55 |
| AAVA3.5 | 134 | US20030138772 SEQ. ID NO: 69 |
| AAVA3.7 | 135 | US20030138772 SEQ ID NO: 56 |
| AAVA3.7 | 136 | US20030138772 SEQ ID NO: 67 |
| AAV29.3 (AA.Vbb.1) | 137 | US20030138772 SEQ ID NO: 11 |
| AAVC2 | 138 | US20030138772 SEQ ID NO: 61 |
| AAVCh.5 | 139 | US20150159173 SEQ ID NO: 46, US20150315612 SEQ ID NO: 234 |
| AAVcy.2 (AAV13.3) | 140 | US20030138772 SEQ ID NO: 15 |
| AAVcy.3 | 141 | US20030138772 SEQ ID NO: 101 |
| AAVcy.3 (AAV24.1) | 142 | US20030138772 SEQ ID NO: 16 |
| AAV27.3 | 143 | US20030138772 SEQ ID NO: 104 |
| AAVcy.4 (AAV27.3) | 144 | US20030138772 SEQ ID NO: 17 |
| AAVcy.5 | 145 | US20150115612 SEQ ID NO: 227 |
| AAV7.2 | 146 | US20030138772 SEQ ID NO: 103 |
| AAVcy.5 (AAV7.2) | 147 | US20030138772 SEQ ID NO: 18 |
| AAV16.3 | 148 | US20030138772 SEQ ID NO: 105 |
| AAVcy.6 (AAV16.3) | 149 | US20030138772 SEQ ID NO: 10 |
| AAVcy.5 | 150 | US20150159173 SEQ ID NO: 8 |
| AAVcy.5 | 151 | US20150159173 SEQ ID NO: 24 |
| AAVCy.5R1 | 152 | US20150159173 |
| AAVCy.5R2 | 153 | US20150159173 |
| AAVCy.5R3 | 154 | US20150159173 |
| AAVCy.5R4 | 155 | US20150159173 |
| AAVDJ | 156 | US20140359799 SEQ ID NO: 3, US7588772 SEQ ID NO: 2 |
| AAVDJ | 157 | US20140359799 SEQ ID NO: 2, US7588772 SEQ ID NO: 1 |
| AAVDJ-8 | 158 | US7588772; Grimm et al 2008 |
| AAVDJ-8 | 159 | US7588772; Grimm et al 2008 |
| AAVF5 | 160 | US20030138772 SEQ ID NO: 110 |
| AAVH2 | 161 | US20030138772 SEQ ID NO: 26 |
| AAVH6 | 162 | US20030138772 SEQ ID NO: 25 |
| AAVhE1.1 | 163 | US9233131 SEQ ID NO: 44 |
| AAVhEr1.14 | 164 | US9233131 SEQ ID NO: 46 |
| AAVhEr1.16 | 165 | US9233131 SEQ ID NO: 48 |
| AAVhEr1.18 | 166 | US9233131 SEQ ID NO: 49 |
| AAVhEr1.23 (AAVhEr2.29) | 167 | US9233131 SEQ ID NO: 53 |
| AAVhEr1.35 | 168 | US9233131 SEQ ID NO: 50 |
| AAVhEr1.36 | 169 | US9233131 SEQ ID NO: 52 |
| AAVhEr1.5 | 170 | US9233131 SEQ ID NO: 45 |
| AAVhEr1.7 | 171 | US9233131 SEQ ID NO: 51 |
| AAVhEr1.8 | 172 | US9233131 SEQ ID NO: 47 |
| AAVhEr2.16 | 173 | US9233131 SEQ ID NO: 55 |
| AAVhEr2.30 | 174 | US9233131 SEQ ID NO. 56 |
| AAVhEr2.31 | 175 | US9233131 SEQ ID NO: 58 |
| AAVhEr2.36 | 176 | US9233131 SEQ ID NO: 57 |
| AAVhEr2.4 | 177 | US9233131 SEQ ID NO: 54 |
| AAVhEr3.1 | 178 | US9233131 SEQ ID NO: 59 |
| AAVhu.1 | 179 | US20150315612 SEQ ID NO: 46 |
| AAVhu.1 | 180 | US20150315612 SEQ ID NO: 144 |
| AAVhu.10 (AAV16.8) | 181 | US20150315612 SEQ ID NO: 56 |
| AAVhu.10 (AAV16.8) | 182 | US20150315612 SEQ ID NO: 156 |
| AAVhu.11 (AAV16.12) | 183 | US20150315612 SEQ ID NO: 57 |

TABLE 1-continued

AAV Serotypes

| Serotype | SEQ ID NO | Reference Information |
|---|---|---|
| AAVhu.11 (AAV16.12) | 184 | US20150315612 SEQ ID NO: 153 |
| AAVhu.12 | 185 | US20150315612 SEQ ID NO: 59 |
| AAVhu.12 | 186 | US20150315612 SEQ ID NO: 154 |
| AAVhu.13 | 187 | US20150159173 SEQ ID NO: 16, US20150315612 SEQ ID NO: 71 |
| AAVhu.13 | 188 | US20150159173 SEQ ID NO: 32, US20150315612 SEQ ID NO: 129 |
| AAVhu.136.1 | 189 | US20150315612 SEQ ID NO: 165 |
| AAVhu.140.1 | 190 | US20150315612 SEQ ID NO: 166 |
| AAVhu.140.2 | 191 | US20150315612 SEQ ID NO: 167 |
| AAVhu.145.6 | 192 | US20150315612 SEQ ID No: 178 |
| AAVhu.15 | 193 | US20150315612 SEQ ID NO: 147 |
| AAVhu.15 (AAV33.4) | 194 | US20150315612 SEQ ID NO: 50 |
| AAVhu.156.1 | 195 | US20150315612 SEQ ID No: 179 |
| AAVhu.16 | 196 | US20150315612 SEQ ID NO: 148 |
| AAVhu.16 (AAV33.8) | 197 | US20150315612 SEQ ID NO: 51 |
| AAVhu.17 | 198 | US20150315612 SEQ ID NO: 83 |
| AAVhu.17 (AAV33.12) | 199 | US20150315612 SEQ ID NO: 4 |
| AAVhu.172.1 | 200 | US20150315612 SEQ ID NO: 171 |
| AAVhu.172.2 | 201 | US20150315612 SEQ ID NO: 172 |
| AAVhu.173.4 | 202 | US20150315612 SEQ ID NO: 173 |
| AAVhu.173.8 | 203 | US20150315612 SEQ ID NO: 175 |
| AAVhu.18 | 204 | US20150315612 SEQ ID NO: 52 |
| AAVhu.18 | 205 | US20150315612 SEQ ID NO: 149 |
| AAVhu.19 | 206 | US20150315612 SEQ ID NO: 62 |
| AAVhu.19 | 207 | US20150315612 SEQ ID NO: 133 |
| AAVhu.2 | 208 | US20150315612 SEQ ID NO: 48 |
| AAVhu.2 | 209 | US20150315612 SEQ ID NO: 143 |
| AAVhu.20 | 210 | US20150315612 SEQ ID NO: 63 |
| AAVhu.20 | 211 | US20150315612 SEQ ID NO: 134 |
| AAVhu.21 | 212 | US20150315612 SEQ ID NO: 65 |
| AAVhu.21 | 213 | US20150315612 SEQ ID NO: 135 |
| AAVhu.22 | 214 | US20150315612 SEQ ID NO: 67 |
| AAVhu.22 | 215 | US20150315612 SEQ ID NO: 138 |
| AAVhu.23 | 216 | US20150315612 SEQ ID NO: 60 |
| AAVhu.23.2 | 217 | US20150315612 SEQ ID NO: 137 |
| AAVhu.24 | 218 | US20150315612 SEQ ID NO: 66 |
| AAVhu.24 | 219 | US20150315612 SEQ ID NO: 136 |
| AAVhu.25 | 220 | US20150315612 SEQ ID NO: 49 |
| AAVhu.25 | 221 | US20150315612 SEQ ID NO: 146 |
| AAVhu.26 | 222 | US20150159173 SEQ ID NO: 17, US20150315612 SEQ ID NO: 61 |
| AAVhu.26 | 223 | US20150159173 SEQ ID NO: 33, US20150315612 SEQ ID NO: 139 |
| AAVhu.27 | 224 | US20150315612 SEQ ID NO: 64 |
| AAVhu.27 | 225 | US20150315612 SEQ ID NO: 140 |
| AAVhu.28 | 226 | US20150315612 SEQ ID NO: 68 |
| AAVhu.28 | 227 | US20150315612 SEQ ID NO: 130 |
| AAVhu.29 | 228 | US20150315612 SEQ ID NO: 69 |
| AAVhu.29 | 229 | US20150159173 SEQ ID NO: 42, US20150315612 SEQ ID NO: 132 |
| AAVhu.29 | 230 | US20150315612 SEQ ID NO: 225 |
| AAVhu.29R | 231 | US20150159173 |
| AAVhu.3 | 232 | US20150315612 SEQ ID NO: 44 |
| AAVhu.3 | 233 | US20150315612 SEQ ID NO: 145 |
| AAVhu.30 | 234 | US20150315612 SEQ ID NO: 70 |
| AAVhu.30 | 235 | US20150315612 SEQ ID NO: 131 |
| AAVhu.31 | 236 | US20150315612 SEQ ID NO: 1 |
| AAVhu.31 | 237 | US20150315612 SEQ ID NO: 121 |
| AAVhu.32 | 238 | US20150315612 SEQ ID NO: 2 |
| AAVhu.32 | 239 | US20150315612 SEQ ID NO: 122 |
| AAVhu.33 | 240 | US20150315612 SEQ ID NO: 75 |
| AAVhu.33 | 241 | US20150315612 SEQ ID NO: 124 |
| AAVhu.34 | 242 | US20150315612 SEQ ID NO: 72 |
| AAVhu.34 | 243 | US20150315612 SEQ ID NO: 125 |
| AAVhu.35 | 244 | US20150315612 SEQ ID NO: 73 |
| AAVhu.35 | 245 | US20150315612 SEQ ID NO: 164 |
| AAVhu.36 | 246 | US20150315612 SEQ ID NO: 74 |
| AAVhu.36 | 247 | US20150315612 SEQ ID NO: 126 |
| AAVhu.37 | 248 | US20150159173 SEQ ID NO: 34, US20150315612 SEQ ID NO: 88 |
| AAVhu.37 (AAV106.1) | 249 | US20150315612 SEQ ID NO: 10, US20150159173 SEQ ID NO: 18 |
| AAVhu.38 | 250 | US20150315612 SEQ ID NO: 161 |
| AAVhu.39 | 251 | US20150315612 SEQ ID NO: 102 |
| AAVhu.39 (AAVLG-9) | 252 | US20150315612 SEQ ID NO: 24 |
| AAVhu.4 | 253 | US20150315612 SEQ ID NO: 47 |

TABLE 1-continued

AAV Serotypes

| Serotype | SEQ ID NO | Reference Information |
| --- | --- | --- |
| AAVhu.4 | 254 | US20150315612 SEQ ID NO: 141 |
| AAVhu.40 | 255 | US20150315612 SEQ ID NO: 87 |
| AAVhu.40 (AAV114.3) | 256 | US20150315612 SEQ ID No: 11 |
| AAVhu.41 | 257 | US20150315612 SEQ ID NO: 91 |
| AAVhu.41 (AAV127.2) | 258 | US20150315612 SEQ ID NO: 6 |
| AAVhu.42 | 259 | US20150315612 SEQ ID NO: 85 |
| AAVhu.42 (AAV127.5) | 260 | US20150315612 SEQ ID NO: 8 |
| AAVhu.43 | 261 | US20150315612 SEQ ID NO: 160 |
| AAVhu.43 | 262 | US20150315612 SEQ ID NO: 236 |
| AAVhu.43 (AAV128.1) | 263 | US20150315612 SEQ ID NO: 80 |
| AAVhu.44 | 264 | US20150159173 SEQ ID NO: 45, US20150315612 SEQ ID NO: 158 |
| AAVhu.44 (AAV128.3) | 265 | US20150315612 SEQ ID NO: 81 |
| AAVhu.44R1 | 266 | US20150159173 |
| AAVhu.44R2 | 267 | US20150159173 |
| AAVhu.44R3 | 268 | US20150159173 |
| AAVhu.45 | 269 | US20150315612 SEQ ID NO: 76 |
| AAVhu.45 | 270 | US20150315612 SEQ ID NO: 127 |
| AAVhu.46 | 271 | US20150315612 SEQ ID NO: 82 |
| AAVhu.46 | 272 | US20150315612 SEQ ID NO: 159 |
| AAVhu.46 | 273 | US20150315612 SEQ ID NO: 224 |
| AAVhu.47 | 274 | US20150315612 SEQ ID NO: 77 |
| AAVhu.47 | 275 | US20150315612 SEQ ID NO: 128 |
| AAVhu.48 | 276 | US20150159173 SEQ ID NO: 38 |
| AAVhu.48 | 277 | US20150315612 SEQ ID NO: 157 |
| AAVhu.48 (AAV130.4) | 278 | US20150315612 SEQ ID NO: 78 |
| AAVhu.48R1 | 279 | US20150159173 |
| AAVhu.48R2 | 280 | US20150159173 |
| AAVhu.48R3 | 281 | US20150159173 |
| AAVhu.49 | 282 | US20150315612 SEQ ID NO: 209 |
| AAVhu.49 | 283 | US20150315612 SEQ ID NO: 189 |
| AAVhu.5 | 284 | US20150315612 SEQ ID NO: 45 |
| AAVhu.5 | 285 | US20150315612 SEQ ID NO: 142 |
| AAVhu.51 | 286 | US20150315612 SEQ ID NO: 208 |
| AAVhu.51 | 287 | US20150315612 SEQ ID NO: 190 |
| AAVhu.52 | 288 | US20150315612 SEQ ID NO: 210 |
| AAVhu.52 | 289 | US20150315612 SEQ ID NO: 191 |
| AAVhu.53 | 290 | US20150159173 SEQ ID NO: 19 |
| AAVhu.53 | 291 | US20150159173 SEQ ID NO: 35 |
| AAVhu.53 (AAV145.1) | 292 | US20150315612 SEQ ID NO: 176 |
| AAVhu.54 | 293 | US20150315612 SEQ ID NO: 188 |
| AAVhu.54 (AAV145.5) | 294 | US20150315612 SEQ ID No: 177 |
| AAVhu.55 | 295 | US20150315612 SEQ ID NO: 187 |
| AAVhu.56 | 296 | US20150315612 SEQ ID NO: 205 |
| AAVhu.56 (AAV145.6) | 297 | US20150315612 SEQ ID NO: 168 |
| AAVhu.56 (AAV145.6) | 298 | US20150315612 SEQ ID NO: 192 |
| AAVhu.57 | 299 | US20150315612 SEQ ID NO: 206 |
| AAVhu.57 | 300 | US20150315612 SEQ ID NO: 169 |
| AAVhu.57 | 301 | US20150315612 SEQ ID NO: 193 |
| AAVhu.58 | 302 | US20150315612 SEQ ID NO: 207 |
| AAVhu.58 | 303 | US20150315612 SEQ ID NO: 194 |
| AAVhu.6 (AAV3.1) | 304 | US20150315612 SEQ ID NO: 5 |
| AAVhu.6 (AAV3.1) | 305 | US20150315612 SEQ ID NO: 84 |
| AAVhu.60 | 306 | US20150315612 SEQ ID NO: 184 |
| AAVhu.60 (AAV161.10) | 307 | US20150315612 SEQ ID NO: 170 |
| AAVhu.61 | 308 | US20150315612 SEQ ID NO: 185 |
| AAVhu.61 (AAV161.6) | 309 | US20150315612 SEQ ID NO: 174 |
| AAVhu.63 | 310 | US20150315612 SEQ ID NO: 204 |
| AAVhu.63 | 311 | US20150315612 SEQ ID NO: 195 |
| AAVhu.64 | 312 | US20150315612 SEQ ID NO: 212 |
| AAVhu.64 | 313 | US20150315612 SEQ ID NO: 196 |
| AAVhu.66 | 314 | US20150315612 SEQ ID NO: 197 |
| AAVhu.67 | 315 | US20150315612 SEQ ID NO: 215 |

TABLE 1-continued

AAV Serotypes

| Serotype | SEQ ID NO | Reference Information |
|---|---|---|
| AAVhu.67 | 316 | US20150315612 SEQ ID NO: 198 |
| AAVhu.7 | 317 | US20150315612 SEQ ID NO: 226 |
| AAVhu.7 | 318 | US20150315612 SEQ ID NO: 150 |
| AAVhu.7 (AAV7.3) | 319 | US20150315612 SEQ ID NO: 55 |
| AAVhu.71 | 320 | US20150315612 SEQ ID NO: 79 |
| AAVhu.8 | 321 | US20150315612 SEQ ID NO: 53 |
| AAVhu.8 | 322 | US20150315612 SEQ ID NO: 12 |
| AAVhu.8 | 323 | US20150315612 SEQ ID NO: 151 |
| AAVhu.9 (AAV3.1) | 324 | US20150315612 SEQ ID NO: 58 |
| AAVhu.9 (AAV3.1) | 325 | US20150315612 SEQ ID NO: 155 |
| AAV-LK01 | 326 | US20150376607 SEQ ID NO: 2 |
| AAV-LK01 | 327 | US20150376607 SEQ ID NO: 29 |
| AAV-LK02 | 328 | US20150376607 SEQ ID NO: 3 |
| AAV-LK02 | 329 | US20150376607 SEQ ID NO: 30 |
| AAV-LK03 | 330 | US20150376607 SEQ ID NO: 4 |
| AAV-LK03 | 331 | WO2015121501 SEQ ID NO: 12, US20150376607 SEQ ID NO: 31 |
| AAV-LK04 | 332 | US20150376607 SEQ ID NO: 5 |
| AAV-LK04 | 333 | US20150376607 SEQ ID NO: 32 |
| AAV-LK05 | 334 | US20150376607 SEQ ID NO: 6 |
| AAV-LK05 | 335 | US20150376607 SEQ ID NO: 33 |
| AAV-LK06 | 336 | US20150376607 SEQ ID NO: 7 |
| AAV-LK06 | 337 | US20150376607 SEQ ID NO: 34 |
| AAV-LK07 | 338 | US20150376607 SEQ ID NO: 8 |
| AAV-LK07 | 339 | US20150376607 SEQ ID NO: 35 |
| AAV-LK08 | 340 | US20150376607 SEQ ID NO: 9 |
| AAV-LK08 | 341 | US20150376607 SEQ ID NO: 36 |
| AAV-LK09 | 342 | US20150376607 SEQ ID NO: 10 |
| AAV-LK09 | 343 | US20150376607 SEQ ID NO: 37 |
| AAV-LK10 | 344 | US20150376607 SEQ ID NO: 11 |
| AAV-LK10 | 345 | US20150376607 SEQ ID NO: 38 |
| AAV-LK11 | 346 | US20150376607 SEQ ID NO: 12 |
| AAV-LK11 | 347 | US20150376607 SEQ ID NO: 39 |
| AAV-LK12 | 348 | US20150376607 SEQ ID NO: 13 |
| AAV-LK12 | 349 | US20150376607 SEQ ID NO: 40 |
| AAV-LK13 | 350 | US20150376607 SEQ ID NO: 14 |
| AAV-LK13 | 351 | US20150376607 SEQ ID NO: 41 |
| AAV-LK14 | 352 | US20150376607 SEQ ID NO: 15 |
| AAV-LK14 | 353 | US20150376607 SEQ ID NO: 42 |
| AAV-LK15 | 354 | US20150376607 SEQ ID NO: 16 |
| AAV-LK15 | 355 | US20150376607 SEQ ID NO: 43 |
| AAV-LK16 | 356 | US20150376607 SEQ ID NO: 17 |
| AAV-LK16 | 357 | US20150376607 SEQ ID NO: 44 |
| AAV-LKl7 | 358 | US20150376607 SEQ ID NO: 18 |
| AAV-LK17 | 359 | US20150376607 SEQ ID NO: 45 |
| AAV-LK18 | 360 | US20150376607 SEQ ID NO: 19 |
| AAV-LK18 | 361 | US20150376607 SEQ ID NO: 46 |
| AAV-LK19 | 362 | US20150376607 SEQ ID NO: 20 |
| AAV-LK19 | 363 | US20150376607 SEQ ID NO: 47 |
| AAV-PAEC | 364 | US20150376607 SEQ ID NO: 1 |
| AAV-PAEC | 365 | US20150376607 SEQ ID NO: 48 |
| AAV-PAEC11 | 366 | US20150376607 SEQ ID NO: 26 |
| AAV-PAEC11 | 367 | US20150376607 SEQ ID NO: 54 |
| AAV-PAEC12 | 368 | US20150376607 SEQ ID NO: 27 |
| AAV-PAEC12 | 369 | US20150376607 SEQ ID NO: 51 |
| AAV-PAEC13 | 370 | US20150376607 SEQ ID NO: 28 |
| AAV-PAEC13 | 371 | US20150376607 SEQ ID NO: 49 |
| AAV-PAEC2 | 372 | US20150376607 SEQ ID NO: 21 |
| AAV-PAEC2 | 373 | US20150376607 SEQ ID NO: 56 |
| AAV-PAEC4 | 374 | US20150376607 SEQ ID NO: 22 |
| AAV-PAEC4 | 375 | US20150376607 SEQ ID NO: 55 |
| AAV-PAEC6 | 376 | US20150376607 SEQ ID NO: 23 |
| AAV-PAEC6 | 377 | US20150376607 SEQ ID NO: 52 |
| AAV-PAEC7 | 378 | US20150376607 SEQ ID NO: 24 |
| AAV-PAEC7 | 379 | US20150376607 SEQ ID NO: 53 |
| AAV-PAEC8 | 380 | US20150376607 SEQ ID NO: 25 |
| AAV-PAEC8 | 381 | US20150376607 SEQ ID NO: 50 |
| AAVpi.1 | 382 | US20150315612 SEQ ID NO: 28 |
| AAVpi.1 | 383 | US20150315612 SEQ ID NO: 93 |
| AAVpi.2 | 384 | US20150315612 SEQ ID NO: 30 |
| AAVpi.2 | 385 | US20150315612 SEQ ID NO: 95 |
| AAVpi.3 | 386 | US20150315612 SEQ ID NO: 29 |
| AAVpi.3 | 387 | US20150315612 SEQ ID NO: 94 |
| AAVrh.10 | 388 | US20150159173 SEQ ID NO: 9 |

TABLE 1-continued

AAV Serotypes

| Serotype | SEQ ID NO | Reference Information |
|---|---|---|
| AAVrh.10 | 389 | US20150159173 SEQ ID NO: 25 |
| AAV44.2 | 390 | US20030138772 SEQ ID NO: 59 |
| AAVrh.10 (AAV44.2) | 391 | US20030138772 SEQ ID NO: 81 |
| AAV42.1B | 392 | US20030138772 SEQ ID NO: 90 |
| AAVrh.12 (AAV42.1b) | 393 | US20030138772 SEQ ID NO: 30 |
| AAVrh.13 | 394 | US20150159173 SEQ ID NO: 10 |
| AAVrh.13 | 395 | US20150159173 SEQ ID NO: 26 |
| AAVrh.13 | 396 | US20150315612 SEQ ID NO: 228 |
| AAVrh.13R | 397 | US20150159173 |
| AAV42.3A | 398 | US20030138772 SEQ ID NO: 87 |
| AAVrh.14 (AAV42.3a) | 399 | US20030138772 SEQ ID NO: 32 |
| AAV42.5A | 400 | US20030138772 SEQ ID NO: 89 |
| AAVrh.17 (AAV42.5a) | 401 | US20030138772 SEQ ID NO: 34 |
| AAV42.5B | 402 | US20030138772 SEQ ID NO: 91 |
| AAVrh.18 (AAV42.5b) | 403 | US20030138772 SEQ ID NO: 29 |
| AAV42.6B | 404 | US20030138772 SEQ ID NO: 112 |
| AAVrh.19 (AAV42.6b) | 405 | US20030138772 SEQ ID NO: 38 |
| AAVrh.2 | 406 | US20150159173 SEQ ID NO: 39 |
| AAVrh.2 | 407 | US20150315612 SEQ ID NO: 231 |
| AAVrh.20 | 408 | US20150159173 SEQ ID NO: 1 |
| AAV42.10 | 409 | US20030138772 SEQ ID NO: 106 |
| AAVrh.21 (AAV42.10) | 410 | US20030138772 SEQ ID NO: 35 |
| AAV42.11 | 411 | US20030138772 SEQ ID NO: 108 |
| AAVrh.22 (AAV42.11) | 412 | US20030138772 SEQ ID NO: 37 |
| AAV42.12 | 413 | US20030138772 SEQ ID NO: 113 |
| AAVrh.23 (AAV42.12) | 414 | US20030138772 SEQ ID NO: 58 |
| AAV42.13 | 415 | US20030138772 SEQ ID NO: 86 |
| AAVrh..24 (AAV42.13) | 416 | US20030138772 SEQ ID NO: 31 |
| AAV42.15 | 417 | US20030138772 SEQ ID NO: 84 |
| AAVrh.25 (AAV42.15) | 418 | US20030138772 SEQ ID NO: 28 |
| AAVrh.2R | 419 | US20150159173 |
| AAVrh.31 (AAV223.1) | 420 | US20030138772 SEQ ID NO: 48 |
| AAVC1 | 421 | US20030138772 SEQ ID NO: 60 |
| AAVrh.32 (AAVC1) | 422 | US20030138772 SEQ ID NO: 19 |
| AAVrh.32/33 | 423 | US20150159173 SEQ ID NO: 2 |
| AAVrh.33 (AAVC3) | 424 | US20030138772 SEQ ID NO: 20 |
| AAVC5 | 425 | US20030138772 SEQ ID NO: 62 |
| AAVrh.34 (AAVC5) | 426 | US20030138772 SEQ ID NO: 21 |
| AAVF1 | 427 | US20030138772 SEQ ID NO: 109 |
| AAVrh.35 (AAVF1) | 428 | US20030138772 SEQ ID NO: 22 |
| AAVF3 | 429 | US20030138772 SEQ ID NO: 111 |
| AAVrh.36 (AAVF3) | 430 | US20030138772 SEQ ID NO: 23 |
| AAVrh.37 | 431 | US20030138772 SEQ ID NO: 24 |
| AAVrh.37 | 432 | US20150159173 SEQ ID NO: 40 |
| AAVrh.37 | 433 | US20150315612 SEQ ID NO: 229 |
| AAVrh.37R2 | 434 | US20150159173 |
| AAVrh.38 (AAVLG-4) | 435 | US20150315612 SEQ ID NO: 7 |
| AAVrh.38 (AAVLG-4) | 436 | US20150315612 SEQ ID NO: 86 |
| AAVrh.39 | 437 | US20150159173 SEQ ID NO: 20, US20150315612 SEQ ID NO: 13 |
| AAVrh.39 | 438 | US20150159173 SEQ ID NO: 3, US20150159173 SEQ ID NO: 36, US20150315612 SEQ ID NO: 89 |
| AAVrh.40 | 439 | US20150315612 SEQ ID NO: 92 |
| AAVrh.40 (AAVLG-10) | 440 | US20150315612 SEQ ID No: 14 |
| AAVrh.43 (AAVN721-8) | 441 | US20150315612 SEQ ID NO: 43, US20150159173 SEQ ID NO: 21 |

TABLE 1-continued

AAV Serotypes

| Serotype | SEQ ID NO | Reference Information |
|---|---|---|
| AAVrh.43 (AAVN721-8) | 442 | US20150315612 SEQ ID NO: 163, US20150159173 SEQ ID NO: 37 |
| AAVrh.44 | 443 | US20150315612 SEQ ID NO: 34 |
| AAVrh.44 | 444 | US20150315612 SEQ ID NO: 111 |
| AAVrh.45 | 445 | US20150315612 SEQ ID NO: 41 |
| AAVrh.45 | 446 | US20150315612 SEQ ID NO: 109 |
| AAVrh.46 | 447 | US20150159173 SEQ ID NO: 22, US20150315612 SEQ ID NO: 19 |
| AAVrh.46 | 448 | US20150159173 SEQ ID NO: 4, US20150315612 SEQ ID NO: 101 |
| AAVrh.47 | 449 | US20150315612 SEQ ID NO: 38 |
| AAVrh.47 | 450 | US20150315612 SEQ ID NO: 118 |
| AAVrh.48 | 451 | US20150159173 SEQ ID NO: 44, US20150315612 SEQ ID NO: 115 |
| AAVrh.48.1 | 452 | US20150159173 |
| AAVrh.48.1.2 | 453 | US20150159173 |
| AAVrh.48.2 | 454 | US20150159173 |
| AAVrh.48 (AAV1-7) | 455 | US20150315612 SEQ ID NO: 32 |
| AAVrh.49 (AAV1-8) | 456 | US20150315612 SEQ ID NO: 25 |
| AAVrh.49 (AAV1-8) | 457 | US20150315612 SEQ ID NO: 103 |
| AAVrh.50 (AAV2-4) | 458 | US20150315612 SEQ ID NO: 23 |
| AAVrh.50 (AAV2-4) | 459 | US20150315612 SEQ ID NO: 108 |
| AAVrh.51 (AAV2-5) | 460 | US20150315612 SEQ ID NO: 22 |
| AAVrh.51 (AAV2-5) | 461 | US20150315612 SEQ ID NO: 104 |
| AAVrh.52 (AAV3-9) | 462 | US20150315612 SEQ ID NO: 18 |
| AAVrh.52 (AAV3-9) | 463 | US20150315612 SEQ ID NO: 96 |
| AAVrh.53 | 464 | US20150315612 SEQ ID NO: 97 |
| AAVrh.53 (AAV3-11) | 465 | US20150315612 SEQ ID NO: 17 |
| AAVrh.53 (AAV3-11) | 466 | US20150315612 SEQ ID NO: 186 |
| AAVrh.54 | 467 | US20150315612 SEQ ID NO: 40 |
| AAVrh.54 | 468 | US20150159173 SEQ ID NO: 49, US20150315612 SEQ ID NO: 116 |
| AAVrh.55 | 469 | US20150315612 SEQ ID NO: 37 |
| AAVrh.55 (AAV4-19) | 470 | US20150315612 SEQ ID NO: 117 |
| AAVrh.56 | 471 | US20150315612 SEQ ID NO: 54 |
| AAVrh.56 | 472 | US20150315612 SEQ ID NO: 152 |
| AAVrh.57 | 473 | US20150315612 SEQ ID NO: 26 |
| AAVrh.57 | 474 | US20150315612 SEQ ID NO: 105 |
| AAVrh.58 | 475 | US20150315612 SEQ ID NO: 27 |
| AAVrh.58 | 476 | US20150159173 SEQ ID NO: 48, US20150315612 SEQ ID NO: 106 |
| AAVrh.58 | 477 | US20150315612 SEQ ID NO: 232 |
| AAVrh.59 | 478 | US20150315612 SEQ ID NO: 42 |
| AAVrh.59 | 479 | US20150315612 SEQ ID NO: 110 |
| AAVrh.60 | 480 | US20150315612 SEQ ID NO: 31 |
| AAVrh.60 | 481 | US20150315612 SEQ ID NO: 120 |
| AAVrh.61 | 482 | US20150315612 SEQ ID NO: 107 |
| AAVrh.61 (AAV2-3) | 483 | US20150315612 SEQ ID NO: 21 |
| AAVrh.62 (AAV2-15) | 484 | US20150315612 SEQ ID NO: 33 |
| AAVrh.62 (AAV2-15) | 485 | US20150315612 SEQ ID NO: 114 |
| AAVrh.64 | 486 | US20150315612 SEQ ID No: 15 |
| AAVrh.64 | 487 | US20150159173 SEQ ID NO: 43, US20150315612 SEQ ID NO: 99 |
| AAVrh.64 | 488 | US20150315612 SEQ ID NO: 233 |
| AAVRh.64R1 | 489 | US20150159173 |
| AAVRh.64R2 | 490 | US20150159173 |
| AAVrh.65 | 491 | US20150315612 SEQ ID NO: 35 |
| AAVrh.65 | 492 | US20150315612 SEQ ID NO: 112 |
| AAVrh.67 | 493 | US20150315612 SEQ ID NO: 36 |
| AAVrh.67 | 494 | US20150315612 SEQ ID NO: 230 |
| AAVrh.67 | 495 | US20150159173 SEQ ID NO: 47, US20150315612 SEQ ID NO: 113 |
| AAVrh.68 | 496 | US20150315612 SEQ ID NO: 16 |
| AAVrh.68 | 497 | US20150315612 SEQ ID NO: 100 |
| AAVrh.69 | 498 | US20150315612 SEQ ID NO: 39 |
| AAVrh.69 | 499 | US20150315612 SEQ ID NO: 119 |
| AAVrh.70 | 500 | US20150315612 SEQ ID NO: 20 |
| AAVrh.70 | 501 | US20150315612 SEQ ID NO: 98 |

TABLE 1-continued

AAV Serotypes

| Serotype | SEQ ID NO | Reference Information |
|---|---|---|
| AAVrh.71 | 502 | US20150315612 SEQ ID NO: 162 |
| AAVrh.72 | 503 | US20150315612 SEQ ID NO: 9 |
| AAVrh.73 | 504 | US20150159173 SEQ ID NO: 5 |
| AAVrh.74 | 505 | US20150159173 SEQ ID NO: 6 |
| AAVrh.8 | 506 | US20150159173 SEQ ID NO: 41 |
| AAVrh.8 | 507 | US20150315612 SEQ ID NO: 235 |
| AAVrh.8R | 508 | US20150159173, WO2015168666 SEQ ID NO: 9 |
| AAVrh.8R A586R mutant | 509 | WO2015168666 SEQ ID NO: 10 |
| AAVrh.8R R533A mutant | 510 | WO2015168666 SEQ ID NO: 11 |
| BAAV (bovine AAV) | 511 | US9193769 SEQ ID NO: 8 |
| BAAV (bovine AAV) | 512 | US9193769 SEQ ID NO: 10 |
| BAAV (bovine AAV) | 513 | US9193769 SEQ ID NO: 4 |
| BAAV (bovine AAV) | 514 | US9193769 SEQ ID NO: 2 |
| BAAV (bovine AAV) | 515 | US9193769 SEQ ID NO: 6 |
| BAAV (bovine AAV) | 516 | US9193769 SEQ ID NO: 1 |
| BAAV (bovine AAV) | 517 | US9193769 SEQ ID NO: 5 |
| BAAV (bovine AAV) | 518 | US9193769 SEQ ID NO: 3 |
| BAAV (bovine AAV) | 519 | US9193769 SEQ ID NO: 11 |
| BAAV (bovine AAV) | 520 | US7427396 SEQ ID NO: 5 |
| BAAV (bovine AAV) | 521 | US7427396 SEC ID NO: 6 |
| BAAV (bovine AAV) | 522 | US9193769 SEQ ID NO: 7 |
| BAAV (bovine AAV) | 523 | US9193769 SEQ ID NO: 9 |
| BNP61 AAV | 524 | US20150238550 SEQ ID NO: 1 |
| BNP61 AAV | 525 | US20150238550 SEQ ID NO: 2 |
| BNP62 AAV | 526 | US20150238550 SEQ ID NO: 3 |
| BNP63 AAV | 527 | US20150238550 SEQ ID NO: 4 |
| caprine AAV | 528 | US7427396 SEQ ID NO: 3 |
| caprine AAV | 529 | US7427396 SEQ ID NO: 4 |
| true type AAV (ttAAV) | 530 | WO2015121501 SEQ ID NO: 2 |
| AAAV (Avian AAV) | 531 | US9238800 SEQ ID NO: 12 |
| AAAV (Avian AAV) | 532 | US9238800 SEQ ID NO: 2 |
| AAAV (Avian AAV) | 533 | US9238800 SEQ ID NO: 6 |
| AAAV (Avian AAV) | 534 | US9238800 SEQ ID NO: 4 |
| AAAV (Avian AAV) | 535 | US9238800 SEQ ID NO: 8 |
| AAAV (Avian AAV) | 536 | US9238800 SEQ ID NO: 14 |
| AAAV (Avian AAV) | 537 | US9238800 SEQ ID NO: 10 |
| AAAV (Avian AAV) | 538 | US9238800 SEQ ID NO: 15 |
| AAAV (Avian AAV) | 539 | US9238800 SEQ ID NO: 5 |
| AAAV (Avian AAV) | 540 | US9238800 SEQ ID NO: 9 |
| AAAV (Avian AAV) | 541 | US9238800 SEQ ID NO: 3 |
| AAAV (Avian AAV) | 542 | US9238800 SEQ ID NO: 7 |
| AAAV (Avian AAV) | 543 | US9238800 SEQ ID NO: 11 |
| AAAV (Avian AAV) | 544 | US9238800 SEQ ID NO: 13 |
| AAAV (Avian AAV) | 545 | US9238800 SEQ ID NO: 1 |

TABLE 1-continued

AAV Serotypes

| Serotype | SEQ ID NO | Reference Information |
|---|---|---|
| AAV Shuffle 100-1 | 546 | US20160017295 SEQ ID NO: 23 |
| AAV Shuffle 100-1 | 547 | US20160017295 SEQ ID NO: 11 |
| AAV Shuffle 100-2 | 548 | US20160017295 SEQ ID NO: 37 |
| AAV Shuffle 100-2 | 549 | US20160017295 SEQ ID NO: 29 |
| AAV Shuffle 100-3 | 550 | US20160017295 SEQ ID NO: 24 |
| AAV Shuffle 100-3 | 551 | US20160017295 SEQ ID NO: 12 |
| AAV Shuffle 100-7 | 552 | US20160017295 SEQ ID NO: 25 |
| AAV Shuffle 100-7 | 553 | US20160017295 SEQ ID NO: 13 |
| AAV Shuffle 10-2 | 554 | US20160017295 SEQ ID NO: 34 |
| AAV Shuffle 10-2 | 555 | US20160017295 SEQ ID NO: 26 |
| AAV Shuffle 10-6 | 556 | US20160017295 SEQ ID NO: 35 |
| AAV Shuffle 10-6 | 557 | US20160017295 SEQ ID NO: 27 |
| AAV Shuffle 10-8 | 558 | US20160017295 SEQ ID NO: 36 |
| AAV Shuffle 10-8 | 559 | US20160017295 SEQ ID NO: 28 |
| AAV SM 100-10 | 560 | US20160017295 SEQ ID NO: 41 |
| AAV SM 100-10 | 561 | US20160017295 SEQ ID NO: 33 |
| AAV SM 100-3 | 562 | US20160017295 SEQ ID NO: 40 |
| AAV SM 100-3 | 563 | US20160017295 SEQ ID NO: 32 |
| AAV SM 10-1 | 564 | US20160017295 SEQ ID NO: 38 |
| AAV SM 10-1 | 565 | US20160017295 SEQ ID NO: 30 |
| AAV SM 10-2 | 566 | US20160017295 SEQ ID NO: 10 |
| AAV SM 10-2 | 567 | US20160017295 SEQ ID NO: 22 |
| AAV SM 10-8 | 568 | US20160017295 SEQ ID NO: 39 |
| AAV SM 10-8 | 569 | US20160017295 SEQ ID NO: 31 |
| AAVF1/HSC1 | 570 | WO2016049230 SEQ ID NO: 20 |
| AAVF2/HSC2 | 571 | WO2016049230 SEQ ID NO: 21 |
| AAVF3/HSC3 | 572 | WO2016019230 SEQ ID NO: 22 |
| AAVF4/HSC4 | 573 | WO2016049230 SEQ ID NO: 23 |
| AAVF5/HSC5 | 574 | WO2016049230 SEQ ID NO: 25 |
| AAVF6/HSC6 | 575 | WO2016049230 SEQ ID NO: 24 |
| AAVF7/HSC7 | 576 | WO2016049130 SEQ ID NO: 27 |
| AAVF8/HSC8 | 577 | WO2016049230 SEQ ID NO: 28 |
| AAVF9/HSC9 | 578 | WO2016049130 SEQ ID NO: 29 |
| AAVF11/HSC11 | 579 | WO2016049230 SEQ ID NO: 26 |
| AAVF12/HSC12 | 580 | WO2016049230 SEQ ID NO: 30 |
| AAVF13/HSC13 | 581 | WO2016049230 SEQ ID NO: 31 |
| AAVF14/HSC14 | 582 | WO2016049230 SEQ ID NO: 32 |
| AAVF15/HSC15 | 583 | WO2016049230 SEQ ID NO: 33 |
| AAVF16/HSC16 | 584 | WO2016049230 SEQ ID NO: 34 |
| AAVF17/HSC17 | 585 | WO2016049230 SEQ ID NO: 35 |
| AAVF1/HSC1 | 586 | WO2016049230 SEQ ID NO: 2 |
| AAVF2/HSC2 | 587 | WO2016049230 SEQ ID NO: 3 |
| AAVF3/HSC3 | 588 | WO2016049230 SEQ ID NO: 5 |
| AAVF4/HSC4 | 589 | WO2016049230 SEQ ID NO: 6 |
| AAVF5/HSC5 | 590 | WO2016049230 SEQ ID NO: 11 |
| AAVF6/HSC6 | 591 | WO2016049230 SEQ ID NO: 7 |
| AAVF7/HSC7 | 592 | WO2016049230 SEQ ID NO: 8 |
| AAVF8/HSC8 | 593 | WO2016049230 SEQ ID NO: 9 |
| AAVF9/HSC9 | 594 | WO2016049230 SEQ ID NO: 10 |
| AAVF11/HSC11 | 595 | WO2016049230 SEQ ID NO: 4 |
| AAVF12/HSC12 | 596 | WO2016049230 SEQ ID NO: 12 |
| AAVF13/HSC13 | 597 | WO2016049230 SEQ ID NO: 14 |
| AAVF14/HSC14 | 598 | WO2016049230 SEQ ID NO: 15 |
| AAVF15/HSC15 | 599 | WO2016049230 SEQ ID NO: 16 |
| AAVF16/HSC16 | 600 | WO2016049230 SEQ ID NO: 17 |
| AAVF17/HSC17 | 601 | WO2016049230 SEQ ID NO: 13 |
| AAV CBr-E1 | 602 | US8734809 SEQ ID NO: 13 |
| AAV CBr-E2 | 603 | US8734809 SEQ ID NO: 14 |

TABLE 1-continued

AAV Serotypes

| Serotype | SEQ ID NO | Reference Information |
|---|---|---|
| AAV CBr-E3 | 604 | US8734809 SEQ ID NO: 15 |
| AAV CBr-E4 | 605 | US8734809 SEQ ID NO: 16 |
| AAV CBr-E5 | 606 | US8734809 SEQ ID NO: 17 |
| AAV CBr-e5 | 607 | US8734809 SEQ ID NO: 18 |
| AAV CBr-E6 | 608 | US8734809 SEQ ID NO: 19 |
| AAV CBr-E7 | 609 | US8734809 SEQ ID NO: 20 |
| AAV CBr-E8 | 610 | US8734809 SEQ ID NO: 21 |
| AAV CLv-D1 | 611 | US8734809 SEQ ID NO: 22 |
| AAV CLv-D2 | 612 | US8734809 SEQ ID NO: 23 |
| AAV CLv-D3 | 613 | US8734809 SEQ ID NO: 24 |
| AAV CLv-D4 | 614 | US8734809 SEQ ID NO: 25 |
| AAV CLv-D5 | 615 | US8734809 SEQ ID NO: 26 |
| AAV CLv-D6 | 616 | US8734809 SEQ ID NO: 27 |
| AAV CLv-D7 | 617 | US8734809 SEQ ID NO: 28 |
| AAV CLv-D8 | 618 | US8734809 SEQ ID NO: 29 |
| AAV CLv-E1 | 619 | US8734809 SEQ ID NO: 13 |
| AAV CLv-R1 | 620 | US8734809 SEQ ID NO: 30 |
| AAV CLv-R2 | 621 | US8734809 SEQ ID NO: 31 |
| AAV CLv-R3 | 622 | US8734809 SEQ ID NO: 32 |
| AAV CLv-R4 | 623 | US8734809 SEQ ID NO: 33 |
| AAV CLv-R5 | 624 | US8734809 SEQ ID NO: 34 |
| AAV CLv-R6 | 625 | US8734809 SEQ ID NO: 35 |
| AAV CLv-R7 | 626 | US8734809 SEQ ID NO: 36 |
| AAV CLv-R8 | 627 | US8734809 SEQ ID NO: 37 |
| AAV CLv-R9 | 628 | US8734809 SEQ ID NO: 38 |
| AAV CLg-F1 | 629 | US8734809 SEQ ID NO: 39 |
| AAV CLg-F2 | 630 | US8734809 SEQ ID NO: 40 |
| AAV CLg-F3 | 631 | US8734809 SEQ ID NO: 41 |
| AAV CLg-F4 | 632 | US8734809 SEQ ID NO: 42 |
| AAV CLg-F5 | 633 | US8734809 SEQ ID NO: 43 |
| AAV CLg-F6 | 634 | US8734809 SEQ ID NO: 43 |
| AAV CLg-F7 | 635 | US8734809 SEQ ID NO: 44 |
| AAV CLg-F8 | 636 | US8734809 SEQ ID NO: 43 |
| AAV CSp-1 | 637 | US8734809 SEQ ID NO: 45 |
| AAV CSp-10 | 638 | US8734809 SEQ ID NO: 46 |
| AAV CSp-11 | 639 | US8734809 SEQ ID NO: 47 |
| AAV CSp-2 | 640 | US8734809 SEQ ID NO: 48 |
| AAV CSp-3 | 641 | US8734809 SEQ ID NO: 49 |
| AAV CSp-4 | 642 | US8734809 SEQ ID NO: 50 |
| AAV CSp-6 | 643 | US8734809 SEQ ID NO: 51 |
| AAV CSp-7 | 644 | US8734809 SEQ ID NO: 52 |
| AAV CSp-8 | 645 | US8734809 SEQ ID NO: 53 |
| AAV CSp-9 | 646 | US8734809 SEQ ID NO: 54 |
| AAV CHt-2 | 647 | US8734809 SEQ ID NO: 55 |
| AAV CHt-3 | 648 | US8734809 SEQ ID NO: 56 |
| AAV CKd-1 | 649 | US8734809 SEQ ID NO: 57 |
| AAV CKd-10 | 650 | US8734809 SEQ ID NO: 58 |
| AAV CKd-2 | 651 | US8734809 SEQ ID NO: 59 |
| AAV CKd-3 | 652 | US8734809 SEQ ID NO: 60 |
| AAV CKd-4 | 653 | US8734809 SEQ ID NO: 61 |
| AAV CKd-6 | 654 | US8734809 SEQ ID NO: 62 |
| AAV CKd-7 | 655 | US8734809 SEQ ID NO: 63 |
| AAV CKd-8 | 656 | US8734809 SEQ ID NO: 64 |
| AAV CLv-1 | 657 | US8734809 SEQ ID NO: 65 |
| AAV CLv-12 | 658 | US8734809 SEQ ID NO: 66 |
| AAV CLv-13 | 659 | US8734809 SEQ ID NO: 67 |
| AAV CLv-2 | 660 | US8734809 SEQ ID NO: 68 |
| AAV CLv-3 | 661 | US8734809 SEQ ID NO: 69 |
| AAV CLv-4 | 662 | US8734809 SEQ ID NO: 70 |
| AAV CLv-6 | 663 | US8734809 SEQ ID NO: 71 |
| AAV CLv-8 | 664 | US8734809 SEQ ID NO: 72 |
| AAV CKd-B1 | 665 | US8734809 SEQ ID NO: 73 |
| AAV CKd-B2 | 666 | US8734809 SEQ ID NO: 74 |
| AAV CKd-B3 | 667 | US8734809 SEQ ID NO: 75 |
| AAV CKd-B4 | 668 | US8734809 SEQ ID NO: 76 |
| AAV CKd-B5 | 669 | US8734809 SEQ ID NO: 77 |
| AAV CKd-B6 | 670 | US8734809 SEQ ID NO: 78 |
| AAV CKd-B7 | 671 | US8734809 SEQ ID NO: 79 |
| AAV CKd-B8 | 672 | US8734809 SEQ ID NO: 80 |
| AAV CKd-H1 | 673 | US8734809 SEQ ID NO: 81 |
| AAV CKd-H2 | 674 | US8734809 SEQ ID NO: 82 |
| AAV CKd-H3 | 675 | US8734809 SEQ ID NO: 83 |
| AAV CKd-H4 | 676 | US8734809 SEQ ID NO: 84 |
| AAV CKd-H5 | 677 | US8734809 SEQ ID NO: 85 |
| AAV CKd-H6 | 678 | US8734809 SEQ ID NO: 77 |
| AAV CHt-1 | 679 | US8734809 SEQ ID NO: 86 |

TABLE 1-continued

AAV Serotypes

| Serotype | SEQ ID NO | Reference Information |
|---|---|---|
| AAV CLv1-1 | 680 | US8734809 SEQ ID NO: 171 |
| AAV CLv1-2 | 681 | US8734809 SEQ ID NO: 172 |
| AAV CLv1-3 | 682 | US8734809 SEQ ID NO: 173 |
| AAV CLv1-4 | 683 | US8734809 SEQ ID NO: 174 |
| AAV Clv1-7 | 684 | US8734809 SEQ ID NO: 175 |
| AAV Clv1-8 | 685 | US8734809 SEQ ID NO: 176 |
| AAV Clv1-9 | 686 | US8734809 SEQ ID NO: 177 |
| AAV Clv1-10 | 687 | US8734809 SEQ ID NO: 178 |
| AAV.VR-355 | 688 | US8734809 SEQ ID NO: 181 |
| AAV.hu.48R3 | 689 | US8734809 SEQ ID NO: 183 |
| AAV CBr-E1 | 690 | US8734809 SEQ ID NO: 87 |
| AAV CBr-E2 | 691 | US8734809 SEQ ID NO: 88 |
| AAV CBr-E3 | 692 | US8734809 SEQ ID NO: 89 |
| AAV CBr-E4 | 693 | US8734809 SEQ ID NO: 90 |
| AAV CBr-E5 | 694 | US8734809 SEQ ID NO: 91 |
| AAV CBr-e5 | 695 | US8734809 SEQ ID NO: 92 |
| AAV CBr-E6 | 696 | US8734809 SEQ ID NO: 93 |
| AAV CBr-E7 | 697 | US8734809 SEQ ID NO: 94 |
| AAV CBr-E8 | 698 | US8734809 SEQ ID NO: 95 |
| AAV CLv-D1 | 699 | US8734809 SEQ ID NO: 96 |
| AAV CLv-D2 | 700 | US8734809 SEQ ID NO: 97 |
| AAV CLv-D3 | 701 | US8734809 SEQ ID NO: 98 |
| AAV CLv-D4 | 702 | US8734809 SEQ ID NO: 99 |
| AAV CLv-D5 | 703 | US8734809 SEQ ID NO: 100 |
| AAV CLv-D6 | 704 | US8734809 SEQ ID NO: 101 |
| AAV CLv-D7 | 705 | US8734809 SEQ ID NO: 102 |
| AAV CLv-D8 | 706 | US8734809 SEQ ID NO: 103 |
| AAV CLv-E1 | 707 | US8734809 SEQ ID NO: 87 |
| AAV CLv-R1 | 708 | US8734809 SEQ ID NO: 104 |
| AAV CLv-R2 | 709 | US8734809 SEQ ID NO: 105 |
| AAV CLv-R3 | 710 | US8734809 SEQ ID NO: 106 |
| AAV CLv-R4 | 711 | US8734809 SEQ ID NO: 107 |
| AAV CLv-R5 | 712 | US8734809 SEQ ID NO: 108 |
| AAV CLv-R6 | 713 | US8734809 SEQ ID NO: 109 |
| AAV CLv-R7 | 714 | US8734809 SEQ ID NO: 110 |
| AAV CLv-R8 | 715 | US8734809 SEQ ID NO: 111 |
| AAV CLv-R9 | 716 | US8734809 SEQ ID NO: 112 |
| AAV CLg-F1 | 717 | US8734809 SEQ ID NO: 113 |
| AAV CLg-F2 | 718 | US8734809 SEQ ID NO: 114 |
| AAV CLg-F3 | 719 | US8734809 SEQ ID NO: 115 |
| AAV CLg-F4 | 720 | US8734809 SEQ ID NO: 116 |
| AAV CLg-F5 | 721 | US8734809 SEQ ID NO: 117 |
| AAV CLg-F6 | 722 | US8734809 SEQ ID NO: 117 |
| AAV CLg-F7 | 723 | US8734809 SEQ ID NO: 118 |
| AAV CLg-F8 | 724 | US8734809 SEQ ID NO: 117 |
| AAV CSp-1 | 725 | US8734809 SEQ ID NO: 119 |
| AAV CSp-10 | 726 | US8734809 SEQ ID NO: 120 |
| AAV CSp-11 | 727 | US8734809 SEQ ID NO: 121 |
| AAV CSp-2 | 728 | US8734809 SEQ ID NO: 122 |
| AAV CSp-3 | 729 | US8734809 SEQ ID NO: 123 |
| AAV CSp-4 | 730 | US8734809 SEQ ID NO: 124 |
| AAV CSp-6 | 731 | US8734809 SEQ ID NO: 125 |
| AAV CSp-7 | 732 | US8734809 SEQ ID NO: 126 |
| AAV CSp-8 | 733 | US8734809 SEQ ID NO: 127 |
| AAV CSp-9 | 734 | US8734809 SEQ ID NO: 128 |
| AAV CHt-2 | 735 | US8734809 SEQ ID NO: 129 |
| AAV CHt-3 | 736 | US8734809 SEQ ID NO: 130 |
| AAV CKd-1 | 737 | US8734809 SEQ ID NO: 131 |
| AAV CKd-10 | 738 | US8734809 SEQ ID NO: 132 |
| AAV CKd-2 | 739 | US8734809 SEQ ID NO: 133 |
| AAV CKd-3 | 740 | US8734809 SEQ ID NO: 134 |
| AAV CKd-4 | 741 | US8734809 SEQ ID NO: 135 |
| AAV CKd-6 | 742 | US8734809 SEQ ID NO: 136 |
| AAV CKd-7 | 743 | US8734809 SEQ ID NO: 137 |
| AAV CKd-8 | 744 | US8734809 SEQ ID NO: 138 |
| AAV CLv-1 | 745 | US8734809 SEQ ID NO: 139 |
| AAV CLv-12 | 746 | US8734809 SEQ ID NO: 140 |
| AAV CLv-13 | 747 | US8734809 SEQ ID NO: 141 |
| AAV CLv-2 | 748 | US8734809 SEQ ID NO: 142 |
| AAV CLv-3 | 749 | US8734809 SEQ ID NO: 143 |
| AAV CLv-4 | 750 | US8734809 SEQ ID NO: 144 |
| AAV CLv-6 | 751 | US8734809 SEQ ID NO: 145 |
| AAV CLv-8 | 752 | US8734809 SEQ ID NO: 146 |
| AAV CKd-B1 | 753 | US8734809 SEQ ID NO: 147 |
| AAV CKd-B2 | 754 | US8734809 SEQ ID NO: 148 |
| AAV CKd-B3 | 755 | US8734809 SEQ ID NO: 149 |

TABLE 1-continued

AAV Serotypes

| Serotype | SEQ ID NO | Reference Information |
|---|---|---|
| AAV CKd-B4 | 756 | US8734809 SEQ ID NO: 150 |
| AAV CKd-B5 | 757 | US8734809 SEQ ID NO: 151 |
| AAV CKd-B6 | 758 | US8734809 SEQ ID NO: 152 |
| AAV CKd-B7 | 759 | US8734809 SEQ ID NO: 153 |
| AAV CKd-B8 | 760 | US8734809 SEQ ID NO: 154 |
| AAV CKd-H1 | 761 | US8734809 SEQ ID NO: 155 |
| AAV CKd-H2 | 762 | US8734809 SEQ ID NO: 156 |
| AAV CKd-H3 | 763 | US8734809 SEQ ID NO: 157 |
| AAV CKd-H4 | 764 | US8734809 SEQ ID NO: 158 |
| AAV CKd-H5 | 765 | US8734809 SEQ ID NO: 159 |
| AAV CKd-H6 | 766 | US8734809 SEQ ID NO: 151 |
| AAV CHt-1 | 767 | US8734809 SEQ ID NO: 160 |
| AAV CHt-P2 | 768 | WO2016065001 SEQ ID NO: 1 |
| AAV CHt-P5 | 769 | WO2016065001 SEQ ID NO: 2 |
| AAV CHt-P9 | 770 | WO2016065001 SEQ ID NO: 3 |
| AAV CBr-7.1 | 771 | WO2016065001 SEQ ID NO: 4 |
| AAV CBr-7.2 | 772 | WO2016065001 SEQ ID NO: 5 |
| AAV CBr-7.3 | 773 | WO2016065001 SEQ ID NO: 6 |
| AAV CBr-7.4 | 774 | WO2016065001 SEQ ID NO: 7 |
| AAV CBr-7.5 | 775 | WO2016065001 SEQ ID NO: 8 |
| AAV CBr-7.7 | 776 | WO2016065001 SEQ ID NO: 9 |
| AAV CBr-7.8 | 777 | WO2016065001 SEQ ID NO: 10 |
| AAV CBr-7.10 | 778 | WO2016065001 SEQ ID NO: 11 |
| AAV CKd-N3 | 779 | WO2016065001 SEQ ID NO: 12 |
| AAV CKd-N4 | 780 | WO2016065001 SEQ ID NO: 13 |
| AAV CKd-N9 | 781 | WO2016065001 SEQ ID NO: 14 |
| AAV CLv-L4 | 782 | WO2016065001 SEQ ID NO: 15 |
| AAV CLv-L5 | 783 | WO2016065001 SEQ ID NO: 16 |
| AAV CLv-L6 | 784 | WO2016065001 SEQ ID NO: 17 |
| AAV CLv-K1 | 785 | WO2016065001 SEQ ID NO: 18 |
| AAV CLv-K3 | 786 | WO2016065001 SEQ ID NO: 19 |
| AAV CLv-K6 | 787 | WO2016065001 SEQ ID NO: 20 |
| AAV CLv-M1 | 788 | WO2016065001 SEQ ID NO: 21 |
| AAV CLv-M11 | 789 | WO2016065001 SEQ ID NO: 22 |
| AAV CLv-M2 | 790 | WO2016065001 SEQ ID NO: 23 |
| AAV CLv-M5 | 791 | WO2016065001 SEQ ID NO: 24 |
| AAV CLv-M6 | 792 | WO2016065001 SEQ ID NO: 25 |
| AAV CLv-M7 | 793 | WO2016065001 SEQ ID NO: 26 |
| AAV CLv-M8 | 794 | WO2016065001 SEQ ID NO: 27 |
| AAV CLv-M9 | 795 | WO2016065001 SEQ ID NO: 28 |
| AAV CHt-P1 | 796 | WO2016065001 SEQ ID NO: 29 |
| AAV CHt-P6 | 797 | WO2016065001 SEQ ID NO: 30 |
| AAV CHt-P8 | 798 | WO2016065001 SEQ ID NO: 31 |
| AAV CHt-6.1 | 799 | WO2016065001 SEQ ID NO: 32 |
| AAV CHt-6.10 | 800 | WO2016065001 SEQ ID NO: 33 |
| AAV CHt-6.5 | 801 | WO2016065001 SEQ ID NO: 34 |
| AAV CHt-6.6 | 802 | WO2016065001 SEQ ID NO: 35 |
| AAV CHt-6.7 | 803 | WO2016065001 SEQ ID NO: 36 |
| AAV CHt-6.8 | 804 | WO2016065001 SEQ ID NO: 37 |
| AAV CSp-8.10 | 805 | WO2016065001 SEQ ID NO: 38 |
| AAV CSp-8.2 | 806 | WO2016065001 SEQ ID NO: 39 |
| AAV CSp-8.4 | 807 | WO2016065001 SEQ ID NO: 40 |
| AAV CSp-8.5 | 808 | WO2016065001 SEQ ID NO: 41 |
| AAV CSp-8.6 | 809 | WO2016065001 SEQ ID NO: 42 |
| AAV CSp-8.7 | 810 | WO2016065001 SEQ ID NO: 43 |
| AAV CSp-8.8 | 811 | WO2016065001 SEQ ID NO: 44 |
| AAV CSp-8.9 | 812 | WO2016065001 SEQ ID NO: 45 |
| AAV CBr-B7.3 | 813 | WO2016065001 SEQ ID NO: 46 |
| AAV CBr-B7.4 | 814 | WO2016065001 SEQ ID NO: 47 |
| AAV3B | 815 | WO2016065001 SEQ ID NO: 48 |
| AAV4 | 816 | WO2016065001 SEQ ID NO: 49 |
| AAV5 | 817 | WO2016065001 SEQ ID NO: 50 |
| AAV CHt-P2 | 818 | WO2016065001 SEQ ID NO: 51 |
| AAV CHt-P5 | 819 | WO2016065001 SEQ ID NO: 52 |
| AAV CHt-P9 | 820 | WO2016065001 SEQ ID NO: 53 |
| AAV CBr-7.1 | 821 | WO2016065001 SEQ ID NO: 54 |
| AAV CBr-7.2 | 822 | WO2016065001 SEQ ID NO: 55 |
| AAV CBr-7.3 | 823 | WO2016065001 SEQ ID NO: 56 |
| AAV CBr-7.4 | 824 | WO2016065001 SEQ ID NO: 57 |
| AAV CBr-7.5 | 825 | WO2016065001 SEQ ID NO: 58 |
| AAV CBr-7.7 | 826 | WO2016065001 SEQ ID NO: 59 |
| AAV CBr-7.8 | 827 | WO2016065001 SEQ ID NO: 60 |
| AAV CBr-7.10 | 828 | WO2016065001 SEQ ID NO: 61 |
| AAV CKd-N3 | 829 | WO2016065001 SEQ ID NO: 62 |
| AAV CKd-N4 | 830 | WO2016065001 SEQ ID NO: 63 |
| AAV CKd-N9 | 831 | WO2016065001 SEQ ID NO: 64 |

TABLE 1-continued

AAV Serotypes

| Serotype | SEQ ID NO | Reference Information |
| --- | --- | --- |
| AAV CLv-L4 | 832 | WO2016065001 SEQ ID NO: 65 |
| AAV CLv-L5 | 833 | WO2016065001 SEQ ID NO: 66 |
| AAV CLv-L6 | 834 | WO2016065001 SEQ ID NO: 67 |
| AAV CLv-K1 | 835 | WO2016065001 SEQ ID NO: 68 |
| AAV CLv-K3 | 836 | WO2016065001 SEQ ID NO: 69 |
| AAV CLv-K6 | 837 | WO2016065001 SEQ ID NO: 70 |
| AAV CLv-M1 | 838 | WO2016065001 SEQ ID NO: 71 |
| AAV CLv-M11 | 839 | WO2016065001 SEQ ID NO: 72 |
| AAV CLv-M2 | 840 | WO2016065001 SEQ ID NO: 73 |
| AAV CLv-M5 | 841 | WO2016065001 SEQ ID NO: 74 |
| AAV CLv-M6 | 842 | WO2016065001 SEQ ID NO: 75 |
| AAV CLv-M7 | 843 | WO2016065001 SEQ ID NO: 76 |
| AAV CLv-M8 | 844 | WO2016065001 SEQ ID NO: 77 |
| AAV CLv-M9 | 845 | WO2016065001 SEQ ID NO: 78 |
| AAV CHt-P1 | 846 | WO2016065001 SEQ ID NO: 79 |
| AAV CHt-P6 | 847 | WO2016065001 SEQ ID NO: 80 |
| AAV CHt-P8 | 848 | WO2016065001 SEQ ID NO: 81 |
| AAV CHt-6.1 | 849 | WO2016065001 SEQ ID NO: 82 |
| AAV CHt-6.10 | 850 | WO2016065001 SEQ ID NO: 83 |
| AAV CHt-6.5 | 851 | WO2016065001 SEQ ID NO: 84 |
| AAV CHt-6.6 | 852 | WO2016065001 SEQ ID NO: 85 |
| AAV CHt-6.7 | 853 | WO2016065001 SEQ ID NO: 86 |
| AAV CHt-6.8 | 854 | WO2016065001 SEQ ID NO: 87 |
| AAV CSp-8.10 | 855 | WO2016065001 SEQ ID NO: 88 |
| AAV CSp-8.2 | 856 | WO2016065001 SEQ ID NO: 89 |
| AAV CSp-8.4 | 857 | WO2016065001 SEQ ID NO: 90 |
| AAV CSp-8.5 | 858 | WO2016065001 SEQ ID NO: 91 |
| AAV CSp-8.6 | 859 | WO2016065001 SEQ ID NO: 92 |
| AAV CSp-8.7 | 860 | WO2016065001 SEQ ID NO: 93 |
| AAV CSp-8.8 | 861 | WO2016065001 SEQ ID NO: 94 |
| AAV CSp-8.9 | 862 | WO2016065001 SEQ ID NO: 95 |
| AAV CBr-B7.3 | 863 | WO2016065001 SEQ ID NO: 96 |
| AAV CBr-B7.4 | 864 | WO2016065001 SEQ ID NO: 97 |
| AAV3B | 865 | WO2016065001 SEQ ID NO: 98 |
| AAV4 | 866 | WO2016065001 SEQ ID NO: 99 |
| AAV5 | 867 | WO2016065001 SEQ ID NO: 100 |
| AAVPHP.B or G2B-26 | 868 | WO2015038958 SEQ ID NO: 8 and 13; GenBankALU85156.1 |
| AAVPHP.B | 869 | WO2015038958 SEQ ID NO: 9 |
| AAVG2B-13 | 870 | WO2015038958 SEQ ID NO: 12 |
| AAVTH1.1-32 | 871 | WO2015038958 SEQ ID NO: 14 |
| AAVTH1.1-35 | 872 | WO2015038958 SEQ ID NO: 15 |

Each of the patents, applications and/or publications listed in Table 1 are hereby incorporated by reference in their entirety.

In one embodiment, the AAV serotype may be, or may have a sequence as described in International Patent Publication WO2015038958, the contents of which are herein incorporated by reference in their entirety, such as, but not limited to, AAV9 (SEQ ID NO: 2 and 11 of WO2015038958 or SEQ ID NO: 127 and 126 respectively herein), PHP.B (SEQ ID NO: 8 and 9 of WO2015038958, herein SEQ ID NO: 868 and 869), G2B-13 (SEQ ID NO: 12 of WO2015038958, herein SEQ ID NO: 870), G2B-26 (SEQ ID NO: 13 of WO2015038958, herein SEQ ID NO: 868 and 869), TH1.1-32 (SEQ ID NO: 14 of WO2015038958, herein SEQ ID NO: 871), TH1.1-35 (SEQ ID NO: 15 of WO2015038958, herein SEQ ID NO: 872) or variants thereof. Further, any of the targeting peptides or amino acid inserts described in WO2015038958, may be inserted into any parent AAV serotype, such as, but not limited to, AAV9 (SEQ ID NO: 126 for the DNA sequence and SEQ ID NO: 127 for the amino acid sequence). In one embodiment, the amino acid insert is inserted between amino acids 586-592 of the parent AAV (e.g., AAV9). In another embodiment, the amino acid insert is inserted between amino acids 588-589 of the parent AAV sequence. The amino acid insert may be, but is not limited to, any of the following amino acid sequences, TLAVPFK (SEQ ID NO: 1 of WO2015038958; herein SEQ ID NO: 873), KFPVALT (SEQ ID NO: 3 of WO2015038958, herein SEQ ID NO: 874), LAVPFK (SEQ ID NO: 31 of WO2015038958; herein SEQ ID NO: 875), AVPFK (SEQ ID NO: 32 of WO2015038958; herein SEQ ID NO: 876), VPFK (SEQ ID NO: 33 of WO02015038958; herein SEQ ID NO: 877), TLAVPF (SEQ ID NO: 34 of WO2015038958; herein SEQ ID NO: 878), TLAVP (SEQ ID NO: 35 of WO2015038958; herein SEQ ID NO: 879), TLAV (SEQ ID NO: 36 of WO2015038958; herein SEQ ID NO: 880), SVSKPFL (SEQ ID NO: 28 of WO2015038958; herein SEQ ID NO: 881), FTLTTPK (SEQ ID NO: 29 of WO2015038958; herein SEQ ID NO: 882), MNATKNV (SEQ ID NO: 30 of WO2015038958; herein SEQ ID NO: 883), QSSQTPR (SEQ ID NO: 54 of WO2015038958; herein SEQ ID NO: 884), ILGTGTS (SEQ ID NO: 55 of WO2015038958; herein SEQ ID NO: 885), TRTNPEA (SEQ ID NO: 56 of WO2015038958; herein SEQ ID NO: 886), NGGTSSS (SEQ ID NO:58 of WO2015038958; herein SEQ ID NO:887), or YTLSQGW (SEQ ID NO: 60 of WO2015038958; herein SEQ ID NO: 888). Non-limiting examples of nucleotide sequences that may encode the amino acid inserts include the following, AAGTITCCTGTGGKCGTTGACT (for SEQ ID NO: 3 of WO2015038958; herein SEQ ID NO: 889), ACYTTGGCGGTGCCTITYAAG (SEQ ID NO: 24 and 49 of WO2015038958; herein SEQ ID NO: 890), AGTGT-GAGTAAGCCITIITG (SEQ ID NO: 25 of WO2015038958; herein SEQ ID NO. 891), TTACGTTGACGACGCCTAAG (SEQ ID NO: 26 of WO2015038958; herein SEQ ID NO:892), ATGAATGC-TACGAAGAATGTG (SEQ ID NO: 27 of WO2015038958; herein SEQ ID NO: 893), CAGTCGTCGCA-GACGCCTAGG (SEQ ID NO: 48 of WO2015038958; herein SEQ ID NO: 894), ATTCTGGGGACTCGGTACTTCG (SEQ ID NO: 50) and 52 of WO2015038958; herein SEQ ID NO: 895), ACGCGGACTAATCCTGAGGCT (SEQ ID NO-51 of WO2015038958; herein SEQ ID NO:896), AATGCiGGGGACTAGTAGTTCT (SEQ ID NO: 53 of WO2015038958; herein SEQ ID NO: 897), or TATACTTTGTCGCAGGGTTGG (SEQ ID NO: 59 of WO2015038958, herein SEQ ID NO: 898).

Viral Genome Component: Inverted Terminal Repeats (ITRs)

The AAV particles of the present invention comprise a viral genome with at least one ITR region and a payload region. In one embodiment, the viral genome has two ITRs. These two ITRs flank the payload region at the 5' and 3' ends. The ITRs function as origins of replication comprising recognition sites for replication. ITRs comprise sequence regions which can be complementary and symmetrically arranged. ITRs incorporated into viral genomes of the invention may be comprised of naturally occurring polynucleotide sequences or recombinantly derived polynucleotide sequences.

The ITRs may be derived from the same serotype as the capsid, selected from any of the serotypes listed in Table 1, or a derivative thereof. The ITR may be of a different serotype than the capsid. In one embodiment, the AAV particle has more than one ITR, In a non-limiting example, the AAV particle has a viral genome comprising two ITRs. In one embodiment, the ITRs are of the same serotype as one another. In another embodiment, the ITRs are of different serotypes. Non-limiting examples include zero, one or both of the ITRs having the same serotype as the capsid. In one embodiment both ITRs of the viral genome of the AAV particle are AAV2 ITRs.

Independently, each ITR may be about 100 to about 150 nucleotides in length. An ITR may be about 100-105 nucleotides in length, 106-110 nucleotides in length, 111-115 nucleotides in length, 116-120 nucleotides in length, 121-125 nucleotides in length, 126-130 nucleotides in length, 131-135 nucleotides in length, 136-140 nucleotides in length, 141-145 nucleotides in length or 146-150 nucleotides in length. In one embodiment, the ITRs are 140-142 nucleotides in length. Non-limiting examples of ITR length are 102, 140, 141, 142, 145 nucleotides in length, and those having at least 95% identity thereto Viral Genome Component: Promoters In one embodiment, the payload region of the viral genome comprises at least one element to enhance the transgene target specificity and expression (See e.g., Powell et al. Viral Expression Cassette Elements to Enhance Transgene Target Specificity and Expression in Gene Therapy, 2015; the contents of which are herein incorporated by reference in its entirety). Non-limiting examples of elements to enhance the transgene target specificity and expression include promoters, endogenous miRNAs, post-transcriptional regulatory elements (PREs, polyadenylation (PolyA) signal sequences and upstream enhancers (USEs), CMV enhancers and introns.

A person skilled in the art may recognize that expression of the polypeptides of the invention in a target cell may require a specific promoter, including but not limited to, a promoter that is species specific, inducible, tissue-specific, or cell cycle-specific (Parr et al., Nat. Med. 3:1145-9 (1997) the contents of which are herein incorporated by reference in their entirety).

In one embodiment, the promoter is deemed to be efficient when it drives expression of the polypeptide(s) encoded in the payload region of the viral genome of the AAV particle.

In one embodiment, the promoter is a promoter deemed to be efficient when it drives expression in the cell being targeted.

In one embodiment, the promoter drives expression of the polypeptides of the invention (e.g., a functional antibody) for a period of time in targeted tissues. Expression driven by a promoter may be for a period of 1 hour, 2, hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 1 week, 8 days, 9 days, 10 days, 11 days, 12 days, 13 days, 2 weeks, 15 days, 16 days, 17 days, 18 days, 19 days, 20 days, 3 weeks, 22 days, 23 days, 24 days, 25 days, 26 days, 27 days, 28 days, 29 days, 30 days, 31 days, 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 21 months, 22 months, 23 months, 2 years, 3 years, 4 years, 5 years, 6 years, 7 years, 8 years, 9 years, 10 years or more than 10 years. Expression may be for 1-5 hours, 1-12 hours, 1-2 days, 1-5 days, 1-2 weeks, 1-3 weeks, 1-4 weeks, 1-2 months, 1-4 months, 1-6 months, 2-6 months, 3-6 months, 3-9 months, 4-8 months, 6-12 months, 1-2 years, 1-5 years, 2-5 years, 3-6 years, 3-8 years, 4-8 years or 5-10 years.

In one embodiment, the promoter drives expression of the polypeptides of the invention (e.g., a functional antibody) for at least 1 month, 2 months, 3 months, 4 months, 5 months, 6 months, 7 months, 8 months, 9 months, 10 months, 11 months, 1 year, 2 years, 3 years 4 years, 5 years, 6 years, 7 years, 8 years, 9 years, 10 years, 11 years, 12 years, 13 years, 14 years, 15 years, 16 years, 17 years, 18 years, 19 years, 20 years, 21 years, 22 years, 23 years, 24 years, 25 years, 26 years, 27 years, 28 years, 29 years, 30 years, 31 years, 32 years, 33 years, 34 years, 35 years, 36 years, 37 years, 38 years, 39 years, 40 years, 41 years, 42 years, 43 years, 44 years, 45 years, 46 years, 47 years, 48 years, 49 years, 50 years, 55 years, 60 years, 65 years, or more than 65 years.

Promoters may be naturally occurring or non-naturally occurring. Non-limiting examples of promoters include viral promoters, plant promoters and mammalian promoters. In some embodiments, the promoters may be human promoters. In some embodiments, the promoter may be truncated.

Promoters which drive or promote expression in most tissues include, but are not limited to, human elongation factor 1α-subunit (EF1α), cytomegalovirus (CMV) immediate-early enhancer and/or promoter, chicken β-actin (CBA) and its derivative CAG, β glucuronidase (GUSB), or ubiquitin C (UBC). Tissue-specific expression elements can be used to restrict expression to certain cell types such as, but not limited to, muscle specific promoters, B cell promoters, monocyte promoters, leukocyte promoters, macrophage promoters, pancreatic acinar cell promoters, endothelial cell promoters, lung tissue promoters, astrocyte promoters, or nervous system promoters which can be used to restrict expression to neurons, astrocytes, or oligodendrocytes.

Non-limiting examples of muscle-specific promoters include mammalian muscle creatine kinase (MCK) promoter, mammalian desmin (DES) promoter, mammalian troponin I (TNNI2) promoter, and mammalian skeletal alpha-actin (ASKA) promoter (see, e.g. U.S. Patent Publication US 20110212529, the contents of which are herein incorporated by reference in their entirety).

Non-limiting examples of tissue-specific expression elements for neurons include neuron-specific enolase (NSE), platelet-derived growth factor (PDGF), platelet-derived growth factor B-chain (PDGF-β), synapsin (Syn), methyl-CpG binding protein 2 (MeCP2), $Ca^{2+}$/calmodulin-dependent protein kinase II (CaM KII), metabotropic glutamate receptor 2 (mGluR2), neurofilament light (NFL) or heavy (NFH), β-globin minigene nβ2, preproenkephalin (PPE), enkephalin (Enk) and excitatory amino acid transporter 2 (EAAT2) promoters. Non-limiting examples of tissue-specific expression elements for astrocytes include glial fibrillary acidic protein (GFAP) and EAAT2 promoters. A non-limiting example of a tissue-specific expression element for oligodendrocytes includes the myelin basic protein (MBP) promoter.

In one embodiment, the promoter may be less than 1 kb. The promoter may have a length of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 501), 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800 nucleotides. The promoter may have a length between 200-300, 200-400, 200-500, 200-60, 200-700, 200-800, 300-400, 300-500, 300-600, 300-700, 300-800, 400-500, 400-600, 400-700, 400-800, 500-600, 500-700, 500-800, 600-700, 600-800 or 700-800.

In one embodiment, the promoter may be a combination of two or more components of the same or different starting or parental promoters such as, but not limited to, CMV and CBA, Each component may have a length of 200, 210, 220, 230, 240, 250, 260, 270, 280, 290, 300, 310, 320, 330, 340, 350, 360, 370, 380, 381, 382, 383, 384, 385, 386, 387, 388, 389, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800. Each component may have a length between 200-300, 200-400, 200-500, 200-600, 200-700), 200-800, 300-400, 300-500, 300-600, 300-700, 300-800, 400-500, 400-600, 400-700, 400-800, 500-600, 500-700, 500-800, 600-700, 600-800 or 700-800. In one embodiment, the promoter is a combination of a 382 nucleotide CMV-enhancer sequence and a 260 nucleotide CBA-promoter sequence.

In one embodiment, the viral genome comprises a ubiquitous promoter. Non-limiting examples of ubiquitous promoters include CMV, CBA (including derivatives CAG, CBh, etc.), EF-1α, PGK, UBC, GUSB (hGBp), and UCOE (promoter of HNRPA2B1-CBX3). Yu et al. (Molecular Pain 2011, 7-63, the contents of which are herein incorporated by reference in their entirety) evaluated the expression of eGFP under the CAG, EF1α, PGK and UBC promoters in rat DRG cells and primary DRG cells using lentiviral vectors and found that UBC showed weaker expression than the other 3 promoters and only 10-12% glial expression was seen for all promoters Soderblom et al. (E. Neuro 2015; the contents of which are herein incorporated by reference in its entirety) evaluated the expression of eGFP in AAV8 with CMV and UBC promoters and AAV2 with the CMV promoter after injection in the motor cortex. Intranasal administration of a plasmid containing a UBC or EF1a promoter showed a sustained airway expression greater than the expression with the CMV promoter (See e.g., Gill et al., Gene Therapy 2001, Vol. 8, 1539-1546; the contents of which are herein incorporated by reference in their entirety). Husain et al. (Gene Therapy 2009 the contents of which are herein incorporated by reference in its entirety) evaluated an HβH construct with a hGUSB promoter, a HSV-1LAT promoter and an NSE promoter and found that the HβH construct showed weaker expression than NSE in mouse brain. Passini and Wolfe (J. Virol. 2001, 12382-12392, the contents of which are herein incorporated by reference in its entirety) evaluated the long term effects of the HβH vector following an intraventricular injection in neonatal mice and found that there was sustained expression for at least 1 year. Low expression in all brain regions was found by Xu et al. (Gene Therapy 2001, 8, 1323-1332; the contents of which are herein incorporated by reference in their entirety) when NFL and NFH promoters were used as compared to the CMV-lacZ, CMV-luc, EF, GFAP, hENK, nAChR, PPE, PPE+wpre, NSE (0.3 kb), NSE (1.8 kb) and NSE (1.8 kb 4 wpre). Xu et al. found that the promoter activity in descending order was NSE (1.8 kb), EF, NSE (0.3 kb), GFAP, CMV, hENK, PPE, NFL and NFH. NFL is a 650 nucleotide promoter and NFH is a 920 nucleotide promoter which are both absent in the liver but NFH is abundant in the sensory proprioceptive neurons, brain and spinal cord and NFH is present in the heart. Scn8a is a 470 nucleotide promoter which expresses throughout the DRG, spinal cord and brain with particularly high expression seen in the hippocampal neurons and cerebellar Purkinje cells, cortex, thalamus and hypothalamus (See e.g., Drews et al. *Identification of evolutionary conserved functional noncoding elements in the promoter region of the sodium channel gene SCN8A*, Mamm Genome (2007) 18:723-731; and Raymond et al *Expression of Alternatively Spliced Sodium Channel α-subunit genes*, Journal of Biological Chemistry (2004) 279(44) 46234-46241; the contents of each of which are herein incorporated by reference in their entireties).

Any of promoters taught by the aforementioned Yu, Soderblom. Gill, Husamin, Passini, Xu, Drews or Raymond may be used in the present inventions.

In one embodiment, the promoter is not cell specific.

In one embodiment, the promoter is a ubiquitin c (UBC) promoter. The UBC promoter may have a size of 300-350 nucleotides. As a non-limiting example, the UBC promoter is 332 nucleotides.

In one embodiment, the promoter is a β-glucuronidase (GUSB) promoter. The CrUSB promoter may have a size of 350-400 nucleotides. As a non-limiting example, the GUSB promoter is 378 nucleotides.

In one embodiment, the promoter is a neurofilament light (NFL) promoter. The NFL promoter may have a size of 600-700 nucleotides. As a non-limiting example, the NFL promoter is 650 nucleotides.

In one embodiment, the promoter is a neurofilament heavy (NFH) promoter. The NFL promoter may have a size of 900-950 nucleotides. As a non-limiting example, the NFH promoter is 920 nucleotides.

In one embodiment, the promoter is a scn8a promoter. The scn8a promoter may have a size of 450-500 nucleotides. As a non-limiting example, the scn8a promoter is 470 nucleotides.

In one embodiment, the promoter is a phosphoglycerate kinase 1 (PGK) promoter.

In one embodiment, the promoter is a chicken β-actin (CBA) promoter.

In one embodiment, the promoter is a cytomegalovirus (CMV) promoter.

In one embodiment, the promoter is a liver or a skeletal muscle promoter. Non-limiting examples of liver promoters include human α-1-antitrypsin (hAAT) and thyroxine binding globulin (TBG). Non-limiting examples of skeletal muscle promoters include Desmin. MCK or synthetic C5-12.

In one embodiment, the promoter is a RNA pol III promoter. As a non-limiting example, the RNA pol III promoter is U6. As a non-limiting example, the RNA pol III promoter is H1.

In one embodiment, the viral genome comprises two promoters. As a non-limiting example, the promoters are an EF1α promoter and a CMV promoter.

In one embodiment, the viral genome comprises an enhancer element, a promoter and/or a 5'UTR intron. The enhancer element, also referred to herein as an "enhancer," may be, but is not limited to, a CMV enhancer, the promoter may be, but is not limited to, a CMV. CBA. UBC, GUSB, NSE, Synapsin, MeCP2, and GFAP promoter and the 5'UTR/intron may be, but is not limited to, SV40, and CBA-MVM. As a non-limiting example, the enhancer, promoter and/or intron used in combination may be: (1) CMV enhancer. CMV promoter. SV40 5'UTR intron, (2) CMV enhancer, CBA promoter, SV 40 5'UTR intron, (3) CMV enhancer, CBA promoter, CBA-MVM 5'UTR intron; (4) UBC promoter; (5) GUSB promoter; (6) NSF promoter; (7) Synapsin promoter; (8) MeCP2 promoter and (9) GFAP promoter.

In one embodiment, the viral genome comprises an engineered promoter.

In another embodiment, the viral genome comprises a promoter from a naturally expressed protein.

Viral Genome Component: Untranslated Regions (UTRs)

By definition, wild type untranslated regions (UTRs) of a gene are transcribed but not translated. Generally, the 5' UTR starts at the transcription start site and ends at the start codon and the 3' UTR starts immediately following the stop codon and continues until the termination signal for transcription.

Features typically found in abundantly expressed genes of specific target organs may be engineered into UTRs to enhance the stability and protein production. As a non-limiting example, a 5' UTR from mRNA normally expressed in the liver (e.g., albumin, serum amyloid A, Apolipoprotein A/B/E, transferrin, alpha fetoprotein, erythropoietin, or Factor VIII) may be used in the viral genomes of the AAV particles of the invention to enhance expression in hepatic cell lines or liver.

While not wishing to be bound by theory, wild-type 5' untranslated regions (UTRs) include features which play roles in translation initiation. Kozak sequences, which are commonly known to be involved in the process by which the ribosome initiates translation of many genes, are usually included in 5' UTRs. Kozak sequences have the consensus CCR(A/G)CCAUGG, where R is a purine (adenine or guanine) three bases upstream of the start codon (ATG), which is followed by another 'G'.

In one embodiment, the 5'UTR in the viral genome includes a Kozak sequence.

In one embodiment, the 5'UTR in the viral genome does not include a Kozak sequence.

While not wishing to be bound by theory, wild-type 3' UTRs are known to have stretches of Adenosines and Uridines embedded therein. These AU rich signatures are particularly prevalent in genes with high rates of turnover. Based on their sequence features and functional properties, the AU rich elements (AREs) can be separated into three classes (Chen et al, 1995, the contents of which are herein incorporated by reference in its entirety); Class I AREs, such as, but not limited to, c-Myc and MyoD, contain several dispersed copies of an AUUUA motif within U-rich regions. Class II AREs, such as, but not limited to, GM-CSF and TNF-a, possess two or more overlapping UUAUUUA(U/AXU/A) nonamers. Class III ARES, such as, but not limited to, c-Jun and Myogenin, are less well defined. These U rich regions do not contain an AUUUA motif. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides. When engineering specific polynucleotides, e.g., payload regions of viral genomes, one or more copies of an ARE can be introduced to make polynucleotides less stable and thereby curtail translation and decrease production of the resultant protein. Likewise, AREs can be identified and removed or mutated to increase the intracellular stability and thus increase translation and production of the resultant protein.

In one embodiment, the 3' UTR of the viral genome may include an oligo(dT) sequence for templated addition of a poly-A tail.

In one embodiment, the viral genome may include at least one miRNA seed, binding site or full sequence, microRNAs (or miRNA or miR) are 19-25 nucleotide noncoding RNAs that bind to the sites of nucleic acid targets and down-regulate gene expression either by reducing nucleic acid molecule stability or by inhibiting translation. A microRNA sequence comprises a "seed" region, i.e., a sequence in the region of positions 2-8 of the mature microRNA, which sequence has perfect Watson-Crick complementarity to the miRNA target sequence of the nucleic acid.

In one embodiment, the viral genome may be engineered to include, alter or remove at least one miRNA binding site, sequence or seed region.

Any UTR from any gene known in the art may be incorporated into the viral genome of the AAV particle. These UTRs, or portions thereof, may be placed in the same orientation as in the gene from which they were selected or they may be altered in orientation or location. In one embodiment, the UTR used in the viral genome of the AAV particle may be inverted, shortened, lengthened, made with one or more other 5' UTRs or 3' UTRs known in the art. As used herein, the term "altered" as it relates to a UTR, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides.

In one embodiment, the viral genome of the AAV particle comprises at least one artificial UTRs which is not a variant of a wild type UTR.

In one embodiment, the viral genome of the AAV particle comprises UTRs which have been selected from a family of transcripts whose proteins share a common function, structure, feature or property.

Viral Genome Component: Polyadenylation Sequence

In one embodiment, the viral genome of the AAV particles of the present invention comprise at least one polyadenylation sequence. The viral genome of the AAV particle may comprise a poly adenylation sequence between the 3' end of the payload coding sequence and the 5' end of the 3'ITR In one embodiment, the polyadenylation sequence or "polyA sequence" may range from absent to about 500 nucleotides in length. The polyadenylation sequence may be, but is not limited to, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, and 500) nucleotides in length.

In one embodiment, the polyadenylation sequence is 50-100 nucleotides in length.

In one embodiment, the polyadenylation sequence is 50-150 nucleotides in length.

In one embodiment, the polyadenylation sequence is 50-160 nucleotides in length.

In one embodiment, the polyadenylation sequence is 50-200 nucleotides in length.

In one embodiment, the polyadenylation sequence is 60-100 nucleotides in length.

In one embodiment, the polyadenylation sequence is 60-150 nucleotides in length.

In one embodiment, the polyadenylation sequence is 60-160 nucleotides in length.

In one embodiment, the polyadenylation sequence is 60-200) nucleotides in length.

In one embodiment, the polyadenylation sequence is 70-100 nucleotides in length.

In one embodiment, the polyadenylation sequence is 70-150 nucleotides in length.

In one embodiment, the polyadenylation sequence is 70-160 nucleotides in length.

In one embodiment, the polyadenylation sequence is 70-200 nucleotides in length.

In one embodiment, the polyadenylation sequence is 80-100 nucleotides in length.

In one embodiment, the polyadenylation sequence is 80-150 nucleotides in length.

In one embodiment, the polyadenylation sequence is 80-160 nucleotides in length.

In one embodiment, the polyadenylation sequence is 80-200 nucleotides in length.

In one embodiment, the polyadenylation sequence is 90-100 nucleotides in length.

In one embodiment, the polyadenylation sequence is 90-150 nucleotides in length.

In one embodiment, the polyadenylation sequence is 90-160 nucleotides in length.

In one embodiment, the polyadenylation sequence is 90-200 nucleotides in length.

Viral Genome Component: Linkers

Viral genomes of the invention may be engineered with one or more spacer or linker regions to separate coding or non-coding regions.

In one embodiment, the payload region of the AAV particle may optionally encode one or more linker sequences. In some cases, the linker may be a peptide linker that may be used to connect the polypeptides encoded by the payload region (i.e., light and heavy antibody chains during expression). Some peptide linkers may be cleaved after expression to separate heavy and light chain domains, allowing assembly of mature antibodies or antibody fragments. Linker cleavage may be enzymatic. In some cases, linkers comprise an enzymatic cleavage site to facilitate intracellular or extracellular cleavage. Some payload regions encode linkers that interrupt polypeptide synthesis during translation of the linker sequence from an mRNA transcript. Such linkers may facilitate the translation of separate protein domains (e.g., heavy and light chain antibody domains) from a single transcript. In some cases, two or more linkers are encoded by a payload region of the viral genome. Non-limiting examples of linkers that may be encoded by the payload region of an AAV particle viral genome are given in Table 2.

TABLE 2

| Linker No. | Description | SEQ ID NO |
|---|---|---|
| L1 | Internal ribosome entry site (IRES) | 899 |
| L2 | Foot and month disease virus 2A (F2A) | 900 |
| L3 | Porcine teschovirus-1 virus 2A (P2A) | 901 |
| L4 | Furin cleavage site (F) | 902 |
| L5 | 5xG4S (SEQ ID NO: 9221) | 903 |
| L6 | 1,4-alpha-glucan-branching enzyme | CHP |
| L7 | 1,4-alpha-glucan-branching enzyme | 904 |
| L8 | 1,4-beta-N-acetylmuramidase | FKK |
| L9 | 1,4-beta-N-acetylmuramidase | 905 |
| L10 | 1,4-beta-N-acetylmuramidase | 906 |
| L11 | 1,4-beta-N-acetylmuramidase | 907 |
| L12 | 1,4-beta-N-acetylmuramidase | 908 |
| L13 | 1,4-beta-N-acetylmuramidase | 909 |
| L14 | 1,4-beta-N-acetylmuramidase | 910 |
| L15 | 1,4-beta-N-acetylmuramidase | 911 |
| L16 | 1,4-beta-N-acetylmuramidase | 912 |
| L17 | 1,4-beta-N-acetylmuramidase | 913 |
| L18 | 1,4-beta-N-acetylmuramidase | 914 |
| L19 | 150aa long hypothetical transcriptional regulator | 915 |
| L20 | 150aa long hypothetical transcriptional regulator | 916 |
| L21 | 1-deoxy-D-xylulose 5-phosphate reductoisomerase | 917 |
| L22 | 1-deoxy-D-xylulose 5-phosphate reductoisomerase | 918 |
| L23 | 1-deoxy-D-xylulose 5-phosphate reductoisomerase | 919 |
| L24 | 1-deoxy-D-xylulose 5-phosphate reductoisomerase | 920 |
| L25 | 235aa long hypothetical biotin-[acetyl-CoA-carboxylase] ligase | 921 |
| L26 | 235aa long hypothetical biotin-[acetyl-CoA-carboxylase] ligase | 922 |
| L27 | 235aa long hypothetical biotin-[acetyl-CoA-carboxylase] ligase | 923 |
| L28 | 2-dehydropantoate 2-reductase | 924 |
| L29 | 2-dehydropantoate 2-reductase | 925 |
| L30 | 2-dehydropantoate 2-reductase | 926 |
| L31 | 2-dehydropantoate 2-reductase | 927 |
| L32 | 2-dehydropantoate 2-reductase | 928 |
| L33 | 2-dehydropantoate 2-reductase | 929 |
| L34 | 2-dehydropantoate 2-reductase, putative | 930 |
| L35 | 2-dehydropantoate 2-reductase, putative | 931 |
| L36 | 4-alpha-glucanotransferase | 932 |
| L37 | 4-alpha-glucanotransferase | 933 |
| L38 | 4-alpha-glucanotransferase | 934 |
| L39 | 4-diphosphocytidyl-2C-methyl-D-erythritol kinase | HAA |
| L40 | 4-diphosphocytidyl-2C-methyl-D-erythritol kinase | 935 |
| L41 | 4-diphosphocytidyl-2C-methyl-D-erythritol kinase | 936 |
| L42 | 4-diphosphocytidyl-2C-methyl-D-erythritol kinase | 937 |
| L43 | 4-diphosphocytidyl-2C-methyl-D-erythritol kinase | 938 |
| L44 | 4-hydroxyphenylpyruvate dioxygenase | 939 |
| L45 | 5-13 amino acids from the N termini of human Ck and CH1 domains linker | 940 |
| L46 | 5-13 amino acids from the N termini of human Ck and CH1 domains linker | ERK |
| L47 | 5-13 amino acids from the N termini of human Ck and CH1 domains linker | 941 |
| L48 | 5-13 amino acids from the N termini of human Ck and CH1 domains linker | 942 |
| L49 | 5-13 amino acids from the N termini of human Ck and CH1 domains linker | 943 |
| L50 | 5-13 amino acids from the N termini of human Ck and CH1 domains linker | 944 |
| L51 | 5'-exonuclease | 945 |
| L52 | 5-methyltetrahydropteroyltriglutamate--homocysteinemethyltransferase | ARL |
| L53 | 5-methyltetrahydropteroyltriglutamate--homocysteinemethyltransferase | 946 |
| L54 | 5-methyltetrahydropteroyltriglutamate--homocysteinemethyltransferase | 947 |
| L55 | 5-methyltetrahydropteroyltriglutamate--homocysteinemethyltransferase | 948 |
| L56 | 5-methyltetrahydropteroyltriglutamate--homocysteinemethyltransferase | 949 |
| L57 | 5'-nucleotidase | 950 |
| L58 | 5'-nucleotidase | 951 |
| L59 | 5'-nucleotidase | 952 |
| L60 | 5'-nucleotidase | 953 |
| L61 | 704aa long hypothetical glycosyltransferase | 954 |
| L62 | 704aa long hypothetical glycosyltransferase | 955 |
| L63 | 80 kDa nuclear cap binding protein | 956 |
| L64 | 80 kDa nuclear cap binding protein | 957 |
| L65 | 80 kDa nuclear cap binding protein | 958 |
| L66 | 80 kDa nuclear cap binding protein | 959 |
| L67 | Acetaldehyde dehydrogenase (acylating) | 960 |
| L68 | Acetaldehyde dehydrogenase (acylating) | 961 |
| L69 | Acetolactate synthase isozyme III small subunit | 962 |
| L70 | Acetylcholine receptor protein, alpha chain | 963 |
| L71 | Acetylcholine receptor protein, beta chain | 964 |
| L72 | Aconitate hydratase 2 | 965 |
| L73 | Aconitate hydratase 2 | 966 |
| L74 | Aconitate hydratase 2 | 967 |
| L75 | Aconitate hydratase 2 | 968 |
| L76 | Aconitate hydratase 2 | 969 |

TABLE 2-continued

Linkers

| Linker No. | Description | SEQ ID NO |
|---|---|---|
| L77 | Acriflavine resistance protein B | DWY |
| L78 | Acriflavine resistance protein B | GGS |
| L79 | Acriflavine resistance protein B | IDQ |
| L80 | Acriflavine resistance protein B | NKV |
| L81 | Acriflavine resistance protein B | SEA |
| L82 | Acriflavine resistance protein B | 970 |
| L83 | Acriflavine resistance protein B | 971 |
| L84 | Acriflavine resistance protein B | 972 |
| L85 | Acriflavine resistance protein B | 973 |
| L86 | Acriflavine resistance protein B | 974 |
| L87 | Acriflavine resistance protein B | 975 |
| L88 | Acriflavine resistance protein B | 976 |
| L89 | Acriflavine resistance protein B | 977 |
| L90 | Acriflavine resistance protein B | 978 |
| L91 | Acriflavine resistance protein B | 979 |
| L92 | Acriflavine resistance protein B | 980 |
| L93 | Acriflavine resistance protein B | 981 |
| L94 | Acriflavine resistance protein B | 982 |
| L95 | Acriflavine resistance protein B | 983 |
| L96 | Acriflavine resistance protein B | 984 |
| L97 | Acriflavine resistance protein B | 985 |
| L98 | Acriflavine resistance protein B | 986 |
| L99 | Acriflavine resistance protein B | 987 |
| L100 | Acriflavine resistance protein B | 988 |
| L101 | Acriflavine resistance protein B | 989 |
| L102 | Acriflavine resistance protein B | 990 |
| L103 | Acriflavine resistance protein B | 991 |
| L104 | Acriflavine resistance protein B | 992 |
| L105 | Acriflavine resistance protein B | 993 |
| L106 | Acyl-CoA thioesterase II | 994 |
| L107 | Acyl-CoA thioesterase II | 995 |
| L108 | Acyl-CoA thioesterase II | 996 |
| L109 | Acyl-CoA thioesterase II | 997 |
| L110 | Acyl-CoA thioesterase II | 998 |
| L111 | Acyl-coenzyme A thioesterase 4 | 999 |
| L112 | Acyl-coenzyme A thioesterase 4 | 1000 |
| L113 | Acyl-coenzyme A thioesterase 4 | 1001 |
| L114 | Acyl-coenzyme A thioesterase 4 | 1002 |
| L115 | Acyl-coenzyme A thioesterase 4 | 1003 |
| L116 | Adenine glycosylase | 1004 |
| L117 | Adenylate cyclase | 1005 |
| L118 | Aerolysin | 1006 |
| L119 | Aerolysin | 1007 |
| L120 | Agglutinin | DWK |
| L121 | Agglutinin isolectin 1 | 1008 |
| L122 | Agglutinin isolectin 1 | 1009 |
| L123 | Aldehyde ferredoxin oxidoreductase | 1010 |
| L124 | Aldehyde oxidoreductase | 1011 |
| L125 | Aldehyde oxidoreductase | 1012 |
| L126 | Aldehyde oxidoreductase | 1013 |
| L127 | Aldehyde oxidoreductase | 1014 |
| L128 | Aldehyde oxidoreductase | 1015 |
| L129 | Alkyl hydroperoxide reductase subunit F | 1016 |
| L130 | Alkyl hydroperoxide reductase subunit F | 1017 |
| L131 | Alkyl hydroperoxide reductase subunit F | 1018 |
| L132 | Alkyl hydroperoxide reductase subunit F | 1019 |
| L133 | Alkyl hydroperoxide reductase subunit F | 1020 |
| L134 | Alkyl hydroperoxide reductase subunit F | 1021 |
| L135 | Alkyl hydroperoxide reductase subunit F | 1022 |
| L136 | Alkyl hydroperoxide reductase subunit F | 1023 |
| L137 | Alkyl hydroperoxide reductase subunit F | 1024 |
| L138 | Alkyl hydroperoxide reductase subunit F | 1025 |
| L139 | Allantoicase | 1026 |
| L140 | Allantoicase | 1027 |
| L141 | Alliin lyase 1 | SAV |
| L142 | Alliin lyase 1 | 1028 |
| L143 | Alliin lyase 1 | 1029 |
| L144 | Alliin lyase 1 | 1030 |
| L145 | Alliin lyase 1 | 1031 |
| L146 | Alpha amylase | 1032 |
| L147 | Alpha amylase | 1033 |
| L148 | Alpha-actinin 1 | 1034 |
| L149 | Alpha-actinin 1 | 1035 |
| L150 | Alpha-adaptin C | 1036 |
| L151 | Alpha-amylase | 1037 |
| L152 | Alpha-glucuronidase | LSD |

TABLE 2-continued

Linkers

| Linker No. | Description | SEQ ID NO |
|---|---|---|
| L153 | Alpha-glucuronidase | 1038 |
| L154 | Alpha-glucuronidase | 1039 |
| L155 | Alpha-glucuronidase | 1040 |
| L156 | Alpha-glucuronidase | 1041 |
| L157 | Alpha-glucuronidase | 1042 |
| L158 | Alpha-glucuronidase | 1043 |
| L159 | Alpha-glucuronidase | 1044 |
| L160 | Alpha-glucuronidase | 1045 |
| L161 | Alpha-glucuronidase | 1046 |
| L162 | Alpha-glucuronidase | 1047 |
| L163 | Alpha-glucuronidase | 1048 |
| L164 | Alpha-glucuronidase | 1049 |
| L165 | Alpha-glucuronidase | 1050 |
| L166 | Alpha-glucuronidase | 1051 |
| L167 | Alpha-glucuronidase | 1052 |
| L168 | Alpha-glucuronidase | 1053 |
| L169 | Alpha-glucuronidase | 1054 |
| L170 | Alpha-glucuronidase | 1055 |
| L171 | Alpha-glucuronidase | 1056 |
| L172 | Alpha-glucuronidase | 1057 |
| L173 | Alpha-glucuronidase | 1058 |
| L174 | Alpha-L-arabinofuranosidase B | 1059 |
| L175 | Alpha-mannosidase | 1060 |
| L176 | Alr2269 protein | 1061 |
| L177 | AMP nucleosidase | 1062 |
| L178 | AMP nucleosidase | 1063 |
| L179 | AMP nucleosidase | 1064 |
| L180 | Angiopoietin-1 receptor | DAG |
| L181 | Angiopoietin-1 receptor | NSG |
| L182 | Angiopoietin-1 receptor | TSA |
| L183 | Angiopoietin-1 receptor | VPR |
| L184 | Angiopoietin-1 receptor | 1065 |
| L185 | Angiopoietin-1 receptor | 1066 |
| L186 | Angiopoietin-1 receptor | 1067 |
| L187 | Angiopoietin-1 receptor | 1068 |
| L188 | Angiopoietin-1 receptor | 1069 |
| L189 | Angiopoietin-1 receptor | 1070 |
| L190 | Angiopoietin-1 receptor | 1071 |
| L191 | Angiopoietin-1 receptor | 1072 |
| L192 | Angiopoietin-1 receptor | 1073 |
| L193 | Angiopoietin-1 receptor | 1074 |
| L194 | Angiopoietin-1 receptor | 1075 |
| L195 | Angiopoietin-1 receptor | 1076 |
| L196 | Angiopoietin-1 receptor | 1077 |
| L197 | Angiopoietin-1 receptor | 1078 |
| L198 | Angiopoietin-1 receptor | 1079 |
| L199 | Angiopoietin-1 receptor | 1080 |
| L200 | Angiopoietin-1 receptor | 1081 |
| L201 | Angiopoietin-1 receptor | 1082 |
| L202 | Angiopoietin-1 receptor | 1083 |
| L203 | Angiopoietin-1 receptor | 1084 |
| L204 | Angiopoietin-1 receptor | 1085 |
| L205 | Annexin A2 | QNK |
| L206 | Annexin A2 | 1086 |
| L207 | Annexin A2 | 1087 |
| L208 | Anthranilate phosphoribosyltransferase | 1088 |
| L209 | AP-2 complex subunit beta-2 | 1089 |
| L210 | Archaeosine tRNA-guanine transglycosylase | LGI |
| L211 | Archaeosine tRNA-guanine transglycosylase | 1090 |
| L212 | Archaeosine tRNA-guanine transglycosylase | 1091 |
| L213 | Archaeosine tRNA-guanine transglycosylase | 1092 |
| L214 | Archaeosine tRNA-guanine transglycosylase | 1093 |
| L215 | Archaeosine tRNA-guanine transglycosylase | 1094 |
| L216 | Archaeosine tRNA-guanine transglycosylase | 1095 |
| L217 | Archaeosine tRNA-guanine transglycosylase | 1096 |
| L218 | Archeal exosome RNA binding protein rrp4 | 1097 |
| L219 | Archeal exosome RNA binding protein rrp4 | 1098 |
| L220 | Archeal exosome RNA binding protein rrp4 | 1099 |
| L221 | Arginyl-tRNA synthetase | IDY |
| L222 | Arginyl-tRNA synthetase | 1100 |
| L223 | Arginyl-tRNA synthetase | 1101 |
| L224 | Arginyl-tRNA synthetase | 1102 |
| L225 | Arrestin | 1103 |
| L226 | Arrestin | 1104 |
| L227 | Arsenite oxidase | 1105 |
| L228 | Artificial linker | PGS |

TABLE 2-continued

Linkers

| Linker No. | Description | SEQ ID NO |
|---|---|---|
| L229 | Artificial linker | ATK |
| L230 | Artificial linker | ASK |
| L231 | Artificial linker | 1106 |
| L232 | Artificial linker | 1107 |
| L233 | Artificial linker | 1108 |
| L234 | Artificial linker | 1109 |
| L235 | Artificial linker | 1110 |
| L236 | Artificial linker | 1111 |
| L237 | ATP phosphoribosyltransferase | ANR |
| L238 | ATP-dependent DNA helicase | YDP |
| L239 | ATP-dependent DNA helicase | 1112 |
| L240 | ATP-dependent DNA helicase | 1113 |
| L241 | ATP-dependent DNA helicase | 1114 |
| L242 | ATP-dependent DNA helicase | 1115 |
| L243 | ATP-dependent DNA helicase | 1116 |
| L244 | ATP-dependent DNA helicase | 1117 |
| L245 | ATP-dependent DNA helicase | 1118 |
| L246 | ATP-dependent DNA helicase | 1119 |
| L247 | AT-rich DNA-binding protein | 1120 |
| L248 | AT-rich DNA-binding protein | 1121 |
| L249 | Axonin-1 | DEG |
| L250 | Axonin-1 | ECF |
| L251 | Axonin-1 | 1122 |
| L252 | Axonin-1 | 1123 |
| L253 | Axonin-1 | 1124 |
| L254 | Axonin-1 | 1125 |
| L255 | Axonin-1 | 1126 |
| L256 | Axonin-1 | 1127 |
| L257 | Axonin-1 | 1128 |
| L258 | Bacilysin biosynthesis protein BacB | 1129 |
| L259 | Bacilysin biosynthesis protein BacB | 1130 |
| L260 | Bacilysin biosynthesis protein BacB | 1131 |
| L261 | Bacilysin biosynthesis protein BacB | 1132 |
| L262 | Bacilysin biosynthesis protein BacB | 1133 |
| L263 | Bacteriophage Mu transposase | 1134 |
| L264 | Bacteriophage Mu transposase | 1135 |
| L265 | Benzoyl-CoA-dihydrodiol lyase | 1136 |
| L266 | Benzoyl-CoA-dihydrodiol lyase | 1137 |
| L267 | Benzoyl-CoA-dihydrodiol lyase | 1138 |
| L268 | Benzoyl-CoA-dihydrodiol lyase | 1139 |
| L269 | Benzoyl-CoA-dihydrodiol lyase | 1140 |
| L270 | Benzoylformate decarboxylase | 1141 |
| L271 | Benzoylformate decarboxylase | 1142 |
| L272 | Benzoylformate decarboxylase | 1143 |
| L273 | Beta-amylase | 1144 |
| L274 | Beta-galactosidase | AIS |
| L275 | Beta-galactosidase | 1145 |
| L276 | Beta-galactosidase | 1146 |
| L277 | Beta-galactosidase | 1147 |
| L278 | Beta-galactosidase | 1148 |
| L279 | Beta-galactosidase | 1149 |
| L280 | Beta-galactosidase | 1150 |
| L281 | Beta-galactosidase | 1151 |
| L282 | Beta-galactosidase | 1152 |
| L283 | Beta-galactosidase | 1153 |
| L284 | Beta-galactosidase | 1154 |
| L285 | Beta-galactosidase | 1155 |
| L286 | Beta-galactosidase | 1156 |
| L287 | Beta-galactosidase | 1157 |
| L288 | Beta-galactosidase | 1158 |
| L289 | Beta-galactosidase | 1159 |
| L290 | Beta-galactosidase | 1160 |
| L291 | Beta-galactosidase | 1161 |
| L292 | Beta-galactosidase | 1162 |
| L293 | Beta-galactosidase | 1163 |
| L294 | Beta-galactosidase | 1164 |
| L295 | Beta-galactosidase | 1165 |
| L296 | Beta-galactosidase | 1166 |
| L297 | Beta-N-acetylhexosaminidase | QRE |
| L298 | Beta-N-acetylhexosaminidase | 1167 |
| L299 | Beta-N-acetylhexosaminidase | 1168 |
| L300 | Beta-N-acetylhexosaminidase | 1169 |
| L301 | Bifunctional NMN adenylyltransferase/Nudix hydrolase | 1170 |
| L302 | Bifunctional purine biosynthesis protein PURH | 1171 |
| L303 | Biliverdin reductase A | EHV |
| L304 | Biliverdin reductase A | LME |

TABLE 2-continued

Linkers

| Linker No. | Description | SEQ ID NO |
|---|---|---|
| L305 | Biliverdin reductase A | 1172 |
| L306 | Biliverdin reductase A | 1173 |
| L307 | Biodegradative arginine decarboxylase | TVQ |
| L308 | Biodegradative arginine decarboxylase | 1174 |
| L309 | Biodegradative arginine decarboxylase | 1175 |
| L310 | Biodegradative arginine decarboxylase | 1176 |
| L311 | Biodegradative arginine decarboxylase | 1177 |
| L312 | Biodegradative arginine decarboxylase | 1178 |
| L313 | Biodegradative arginine decarboxylase | 1179 |
| L314 | Biodegradative arginine decarboxylase | 1180 |
| L315 | Biodegradative arginine decarboxylase | 1181 |
| L316 | Biodegradative arginine decarboxylase | 1182 |
| L317 | Biodegradative arginine decarboxylase | 1183 |
| L318 | Biodegradative arginine decarboxylase | 1184 |
| L319 | Biodegradative arginine decarboxylase | 1185 |
| L320 | Biotin carboxylase | 1186 |
| L321 | Bowman-Birk trypsin inhibitor | 1187 |
| L322 | Bpt4 gene 59 helicase assembly protein | KQI |
| L323 | BRCA1-associated RING domain protein 1 | 1188 |
| L324 | BRCA1-associated RING domain protein 1 | 1189 |
| L325 | BRCA1-associated RING domain protein 1 | 1190 |
| L326 | Breast cancer 2 | 1191 |
| L327 | Breast cancer 2 | 1192 |
| L328 | Breast cancer 2 | 1193 |
| L329 | Breast cancer 2 | 1194 |
| L330 | Breast cancer 2 | 1195 |
| L331 | Breast cancer 2 | 1196 |
| L332 | Butyrate response factor 2 | 1197 |
| L333 | C4b-binding protein | YKR |
| L334 | C4b-binding protein | 1198 |
| L335 | C5a peptidase | 1199 |
| L336 | C5a peptidase | 1200 |
| L337 | C5a peptidase | 1201 |
| L338 | C5a peptidase | 1202 |
| L339 | C5a peptidase | 1203 |
| L340 | C5a peptidase | 1204 |
| L341 | C5a peptidase | 1205 |
| L342 | C5a peptidase | 1206 |
| L343 | C5a peptidase | 1207 |
| L344 | C5a peptidase | 1208 |
| L345 | C5a peptidase | 1209 |
| L346 | C5a peptidase | 1210 |
| L347 | C5a peptidase | 1211 |
| L348 | Calcium-binding protein | 1212 |
| L349 | CarA | 1213 |
| L350 | CarA | 1214 |
| L351 | Carbamoyl phosphate synthetase (small chain) | 1215 |
| L352 | Carbamoyl phosphate synthetase (small chain) | 1216 |
| L353 | Carbamoyl phosphate synthetase (small chain) | 1217 |
| L354 | Carbamoyl phosphate synthetase (small chain) | 1218 |
| L355 | Carbamoyl phosphate synthetase (small chain) | 1219 |
| L356 | Carbon monoxide dehydrogenase/acetyl-CoA synthase subunitalpha | 1220 |
| L357 | Carboxypeptidase Gp180 residues 503-882 | HRG |
| L358 | Catabolite activation-like protein | 1221 |
| L359 | Catabolite activation-like protein | 1222 |
| L360 | Catechol 2,3-dioxygenase | 1223 |
| L361 | Cation-independent mannose 6-phosphate receptor | 1224 |
| L362 | CD3 epsilon and gamma ectodomain fragment complex | 1225 |
| L363 | CD3 epsilon and gamma ectodomain fragment complex | 1226 |
| L364 | Cell filamentation protein | SNP |
| L365 | Cell filamentation protein | 1227 |
| L366 | Cell filamentation protein | 1228 |
| L367 | Cellular coagulation factor XIII zymogen | DIT |
| L368 | Cellular coagulation factor XIII zymogen | NSD |
| L369 | Cellular coagulation factor XIII zymogen | TDT |
| L370 | Cellular coagulation factor XIII zymogen | 1229 |
| L371 | Cellular coagulation factor XIII zymogen | 1230 |
| L372 | Cellular coagulation factor XIII zymogen | 1231 |
| L373 | Cellular coagulation factor XIII zymogen | 1232 |
| L374 | Cellular coagulation factor XIII zymogen | 1233 |
| L375 | Cellular coagulation factor XIII zymogen | 1234 |
| L376 | Cellular coagulation factor XIII zymogen | 1235 |
| L377 | Cellular coagulation factor XIII zymogen | 1236 |
| L378 | Cellular coagulation factor XIII zymogen | 1237 |
| L379 | Cellular coagulation factor XIII zymogen | 1238 |
| L380 | Cellular coagulation factor XIII zymogen | 1239 |

TABLE 2-continued

Linkers

| Linker No. | Description | SEQ ID NO |
|---|---|---|
| L381 | Cellular coagulation factor XIII zymogen | 1240 |
| L382 | Cellular coagulation factor XIII zymogen | 1241 |
| L383 | Cellular coagulation factor XIII zymogen | 1242 |
| L384 | Cellular coagulation factor XIII zymogen | 1243 |
| L385 | Cellular coagulation factor XIII zymogen | 1244 |
| L386 | Cellular coagulation factor XIII zymogen | 1245 |
| L387 | Cellular coagulation factor XIII zymogen | 1246 |
| L388 | Cellular coagulation factor XIII zymogen | 1247 |
| L389 | Cellulase | 1248 |
| L390 | Cellulase | 1249 |
| L391 | Cellulase | 1250 |
| L392 | Cellulase | 1251 |
| L393 | Cellulase | 1252 |
| L394 | Cellulase | 1253 |
| L395 | Cellulase | 1254 |
| L396 | Cellulase | 1255 |
| L397 | Cellulase | 1256 |
| L398 | Cellulase linker | 1257 |
| L399 | Cellulase linker | 1258 |
| L400 | Cellulase linker | 1259 |
| L401 | Cellulase linker | 1260 |
| L402 | Chaperone protein FimC | KLR |
| L403 | Chaperone protein FimC | QAA |
| L404 | Chaperone protein FimC | 1261 |
| L405 | Chaperone protein FimC | 1262 |
| L406 | Chaperone protein HscB | RHP |
| L407 | Chaperone protein HscB | 1263 |
| L408 | CheB methylesterase | 1264 |
| L409 | CheB methylesterase | 1265 |
| L410 | CheB methylesterase | 1266 |
| L411 | Chelatase, putative | 1267 |
| L412 | Chemotaxis receptor methyltransferase cheR | 1268 |
| L413 | Chemotaxis receptor methyltransferase cheR | 1269 |
| L414 | Chemotaxis receptor methyltransferase cheR | 1270 |
| L415 | Cholesterol oxidase | 1271 |
| L416 | Cholesterol oxidase | 1272 |
| L417 | Cholesterol oxidase | 1273 |
| L418 | Cholesterol oxidase | 1274 |
| L419 | Cholesterol oxidase | 1275 |
| L420 | Cholesterol oxidase | 1276 |
| L421 | Cholesterol oxidase | 1277 |
| L422 | Cholesterol oxidase | 1278 |
| L423 | Cholesterol oxidase | 1279 |
| L424 | Cholesterol oxidase | 1280 |
| L425 | Cholesterol oxidase | 1281 |
| L426 | Cholesterol oxidase | 1282 |
| L427 | Chromatin structure-remodeling complex protein RSC4 | KNL |
| L428 | Chromatin structure-remodeling complex protein RSC4 | 1283 |
| L429 | Chromatin structure-remodeling complex protein RSC4 | 1284 |
| L430 | Chromatin structure-remodeling complex protein RSC4 | 1285 |
| L431 | Chromodomain-helicase-DNA-binding protein 1 | 1286 |
| L432 | Chromodomain-helicase-DNA-binding protein 1 | 1287 |
| L433 | Cleavable disulfide | 1288 |
| L434 | Cleavable disulfide | 1289 |
| L435 | Cleavable disulfide | 1290 |
| L436 | Cleavable disulfide | 1291 |
| L437 | Cleavable disulfide | 1292 |
| L438 | Cleavable disulfide | 1293 |
| L439 | Cleavable disulfide | 1294 |
| L440 | Cleavable disulfide | 1295 |
| L441 | Cleavable disulfide | 1296 |
| L442 | Cleavable disulfide | 1297 |
| L443 | Cleavable disulfide | 1298 |
| L444 | Colicin Ia | 1299 |
| L445 | Collagen adhesin | 1300 |
| L446 | Complement C3 beta chain | 1301 |
| L447 | Complement C3 beta cliain | 1302 |
| L448 | Complement C3 beta chain | 1303 |
| L449 | Complement C3 beta cliain | 1304 |
| L450 | Complement decay-accelerating factor | EIY |
| L451 | Complement factor H | KRP |
| L452 | Complement receptor type 2 | 1305 |
| L453 | Conserved hypothetical protein | 1306 |
| L454 | Conserved hypothetical protein MTH1747 | DIR |
| L455 | Conserved hypothetical protein MTH1747 | 1307 |
| L456 | Conserved hypothetical protein MTH1747 | 1308 |

TABLE 2-continued

Linkers

| Linker No. | Description | SEQ ID NO |
|---|---|---|
| L457 | Conserved hypothetical protein MTH1747 | 1309 |
| L458 | Conserved hypothetical protein MTH1747 | 1310 |
| L459 | Conserved hypothetical protein MTH1747 | 1311 |
| L460 | Conserved hypothetical protein MTH1747 | 1312 |
| L461 | Conserved hypothetical protein MTH1747 | 1313 |
| L462 | Conserved protein (MTH177) | 1314 |
| L463 | Creatine amidinohydrolase | 1315 |
| L464 | Cruciferin | 1316 |
| L465 | Cruciferin | 1317 |
| L466 | Cruciferin | 1318 |
| L467 | Cruciferin | 1319 |
| L468 | Cruciferin | 1320 |
| L469 | Cruciferin | 1321 |
| L470 | Cruciferin | 1322 |
| L471 | CSL3 | 1323 |
| L472 | CSL3 | 1324 |
| L473 | CTP synthase | 1325 |
| L474 | CTP synthase | 1326 |
| L475 | Cullin homolog | HKN |
| L476 | Cullin homolog | 1327 |
| L477 | Cullin homolog | 1328 |
| L478 | Cullin homolog | 1329 |
| L479 | Cullin homolog | 1330 |
| L480 | Cullin homolog | 1331 |
| L481 | Cyclin A2 | 1332 |
| L482 | Cysteine-rich secretory protein | 1333 |
| L483 | Cytidine deaminase | 1334 |
| L484 | Cytidine deaminase | 1335 |
| L485 | Cytidine deaminase | 1336 |
| L486 | Cytochrome b-c1 complex subunit Rieske, mitochondrial | 1337 |
| L487 | Cytochrome c oxidase subunit 2 | QAV |
| L488 | Cytochrome c oxidase subunit 2 | 1338 |
| L489 | Cytochrome c oxidase subunit 2 | 1339 |
| L490 | Cytochrome c oxidase subunit 2 | 1340 |
| L491 | Cytochrome c oxidase subunit 2 | 1341 |
| L492 | Cytochrome c4 | GGK |
| L493 | Cytochrome c4 | QGM |
| L494 | D-aminopeptidase | 1342 |
| L495 | DDMC | 1343 |
| L496 | DDMC | 1344 |
| L497 | Deltex protein | 1345 |
| L498 | Deoxyuridine 5'-triphosphate nucleotidohydrolase | 1346 |
| L499 | Diaminopimelate epimerase | 1347 |
| L500 | Diaminopimelate epimerase | 1348 |
| L501 | Diaminopimelate epimerase | 1349 |
| L502 | Di-heme peroxidase | SGC |
| L503 | Di-heme peroxidase | 1350 |
| L504 | Dihydropyrimidine dehydrogenase | 1351 |
| L505 | Dihydropyrimidine dehydrogenase | 1352 |
| L506 | Dihydropyrimidine dehydrogenase | 1353 |
| L507 | Dihydropyrimidine dehydrogenase | 1354 |
| L508 | Dihydropyrimidine dehydrogenase | 1355 |
| L509 | Dihydropyrimidine dehydrogenase | 1356 |
| L510 | Dihydropyrimidine dehydrogenase | 1357 |
| L511 | Dihydropyrimidine dehydrogenase | 1358 |
| L512 | Dihydropyrimidine dehydrogenase | 1359 |
| L513 | Dihydropyrimidine dehydrogenase | 1360 |
| L514 | Dihydropyrimidine dehydrogenase | 1361 |
| L515 | Dihydropyrimidine dehydrogenase | 1362 |
| L516 | Dihydropyrimidine dehydrogenase | 1363 |
| L517 | Dihydropyrimidine dehydrogenase | 1364 |
| L518 | Dihydropyrimidine dehydrogenase | 1365 |
| L519 | Dihydropyrimidine dehydrogenase | 1366 |
| L520 | Dihydropyrimidine dehydrogenase | 1367 |
| L521 | Dihydropyrimidine dehydrogenase | 1368 |
| L522 | Dihydropyrimidine dehydrogenase | 1369 |
| L523 | Dihydropyrimidine dehydrogenase | 1370 |
| L524 | Dihydropyrimidine dehydrogenase | 1371 |
| L525 | Dihydropyrimidine dehydrogenase | 1372 |
| L526 | Dihydropyrimidine dehydrogenase | 1373 |
| L527 | Dihydropyrimidine dehydrogenase | 1374 |
| L528 | Dihydropyrimidine dehydrogenase | 1375 |
| L529 | Dihydropyrimidine dehydrogenase | 1376 |
| L530 | Dihydropyrimidine dehydrogenase | 1377 |
| L531 | Dihydropyrimidine dehydrogenase | 1378 |
| L532 | Dihydropyrimidine dehydrogenase | 1379 |

TABLE 2-continued

Linkers

| Linker No. | Description | SEQ ID NO |
|---|---|---|
| L533 | Dihydropyrimidine dehydrogenase | 1380 |
| L534 | Dihydropyrimidine dehydrogenase | 1381 |
| L535 | Discoidin-1 subunit A | 1382 |
| L536 | Discoidin-1 subunit A | 1383 |
| L537 | Discoidin-1 subunit A | 1384 |
| L538 | Dissimilatory copper-containing nitritereductase | 1385 |
| L539 | D-lactate dehydrogenase | DTF |
| L540 | D-lactate dehydrogenase | 1386 |
| L541 | D-lactate dehydrogenase | 1387 |
| L542 | D-lactate dehydrogenase | 1388 |
| L543 | D-lactate dehydrogenase | 1389 |
| L544 | D-lactate dehydrogenase | 1390 |
| L545 | D-lactate dehydrogenase | 1391 |
| L546 | DNA damage-binding protein 1 | LCA |
| L547 | DNA damage-binding protein 1 | 1392 |
| L548 | DNA damage-binding protein 1 | 1393 |
| L549 | DNA damage-binding protein 1 | 1394 |
| L550 | DNA damage-binding protein 1 | 1395 |
| L551 | DNA damage-binding protein 1 | 1396 |
| L552 | DNA damage-binding protein 1 | 1397 |
| L553 | DNA damage-binding protein 1 | 1398 |
| L554 | DNA damage-binding protein 1 | 1399 |
| L555 | DNA damage-binding protein 1 | 1400 |
| L556 | DNA damage-binding protein 1 | 1401 |
| L557 | DNA damage-binding protein 1 | 1402 |
| L558 | DNA damage-binding protein 1 | 1403 |
| L559 | DNA damage-binding protein 1 | 1404 |
| L560 | DNA damage-binding protein 1 | 1405 |
| L561 | DNA damage-binding protein 1 | 1406 |
| L562 | DNA damage-binding protein 1 | 1407 |
| L563 | DNA damage-binding protein 1 | 1408 |
| L564 | DNA damage-binding protein 1 | 1409 |
| L565 | DNA damage-binding protein 1 | 1410 |
| L566 | DNA damage-binding protein 1 | 1411 |
| L567 | DNA damage-binding protein 1 | 1412 |
| L568 | DNA damage-binding protein 1 | 1413 |
| L569 | DNA gyrase B | ALS |
| L570 | DNA gyrase B | 1414 |
| L571 | DNA gyrase B | 1415 |
| L572 | DNA gyrase B | 1416 |
| L573 | DNA gyrase B | 1417 |
| L574 | DNA gyrase B | 1418 |
| L575 | DNA gyrase B | 1419 |
| L576 | DNA gyrase B | 1420 |
| L577 | DNA gyrase B | 1421 |
| L578 | DNA gyrase B | 1422 |
| L579 | DNA gyrase B | 1423 |
| L580 | DNA gyrase B | 1424 |
| L581 | DNA ligase | 1425 |
| L582 | DNA ligase | 1426 |
| L583 | DNA ligase | 1427 |
| L584 | DNA ligase | 1428 |
| L585 | DNA ligase | 1429 |
| L586 | DNA mismatch repair protein MutS | MDA |
| L587 | DNA mismatch repair protein MutS | SII |
| L588 | DNA mismatch repair protein MutS | 1430 |
| L589 | DNA mismatch repair protein MutS | 1431 |
| L590 | DNA mismatch repair protein MutS | 1432 |
| L591 | DNA mismatch repair protein MutS | 1433 |
| L592 | DNA mismatch repair protein MutS | 1434 |
| L593 | DNA polymerase | FSP |
| L594 | DNA polymerase | RQF |
| L595 | DNA polymerase | 1435 |
| L596 | DNA polymerase | 1436 |
| L597 | DNA polymerase | 1437 |
| L598 | DNA polymerase | 1438 |
| L599 | DNA polymerase | 1439 |
| L600 | DNA polymerase | 1440 |
| L601 | DNA polymerase | 1441 |
| L602 | DNA polymerase | 1442 |
| L603 | DNA polymerase alpha subunit B | 1443 |
| L604 | DNA polymerase alpha subunit B | 1444 |
| L605 | DNA polymerase alpha subunit B | 1445 |
| L606 | DNA polymerase alpha subunit B | 1446 |
| L607 | DNA polymerase alpha subunit B | 1447 |
| L608 | DNA polymerase alpha subunit B | 1448 |

TABLE 2-continued

Linkers

| Linker No. | Description | SEQ ID NO |
|---|---|---|
| L609 | DNA polymerase alpha subunit B | 1449 |
| L610 | DNA polymerase alpha subunit B | 1450 |
| L611 | DNA polymerase alpha subunit B | 1451 |
| L612 | DNA polymerase alpha subunit B | 1452 |
| L613 | DNA polymerase eta | ALS |
| L614 | DNA polymerase eta | 1453 |
| L615 | DNA polymerase eta | 1454 |
| L616 | DNA polymerase eta | 1455 |
| L617 | DNA polymerase eta | 1456 |
| L618 | DNA polymerase eta | 1457 |
| L619 | DNA polymerase I | AGV |
| L620 | DNA polymerase I | ELE |
| L621 | DNA polymerase I | 1458 |
| L622 | DNA primase | DHK |
| L623 | DNA primase | 1459 |
| L624 | DNA primase | 1460 |
| L625 | DNA primase | 1461 |
| L626 | DNA primase | 1462 |
| L627 | DNA primase | 1463 |
| L628 | DNA primase | 1464 |
| L629 | DNA primase | 1465 |
| L630 | DNA primase/helicase | AGY |
| L631 | DNA primase/helicase | 1466 |
| L632 | DNA primase/helicase | 1467 |
| L633 | DNA primase/helicase | 1468 |
| L634 | DNA primase/helicase | 1469 |
| L635 | DNA primase/helicase | 1470 |
| L630 | DNA primase/helicase | 1471 |
| L637 | DNA primase/helicase | 1472 |
| L638 | DNA primase/helicase | 1473 |
| L639 | DNA primase/helicase | 1474 |
| L640 | DNA primase/helicase | 1475 |
| L641 | DNA topoisomerase 2 | EES |
| L642 | DNA topoisomerase 2 | IPI |
| L643 | DNA topoisomerase 2 | KEL |
| L644 | DNA topoisomerase 2 | 1476 |
| L645 | DNA topoisomerase 2 | 1477 |
| L646 | DNA topoisomerase 2 | 1478 |
| L647 | DNA topoisomerase 2 | 1479 |
| L648 | DNA topoisomerase 2 | 1480 |
| L649 | DNA topoisomerase 2 | 1481 |
| L650 | DNA topoisomerase 2 | 1482 |
| L651 | DNA topoisomerase 2 | 1483 |
| L652 | DNA topoisomerase 2 | 1484 |
| L653 | DNA topoisomerase I | 1485 |
| L654 | DNA topoisomerase I | 1486 |
| L655 | DNA topoisomerase I | 1487 |
| L656 | DNA topoisomerase II, alpha isozyme | PDL |
| L657 | DNA topoisomerase II, alpha isozyme | 1488 |
| L658 | DNA topoisomerase II, alpha isozyme | 1489 |
| L659 | DNA topoisomerase II, alpha isozyme | 1490 |
| L660 | DNA topoisomerase II, alpha isozyme | 1491 |
| L661 | DNA topoisomerase II, alpha isozyme | 1492 |
| L662 | DNA topoisomerase II, alpha isozyme | 1493 |
| L663 | DNA topoisomerase II, alpha isozyme | 1494 |
| L664 | DNA topoisomerase II, alpha isozyme | 1495 |
| L665 | DNA topoisomerase VI A subunit | 1496 |
| L666 | DNA topoisomerase VI A subunit | 1497 |
| L667 | DNA topoisomerase VI A subunit | 1498 |
| L668 | DNA topoisomerase VI A subunit | 1499 |
| L669 | DNA topoisomerase VI A subunit | 1500 |
| L670 | DNA topoisomerase VI A subunit | 1501 |
| L671 | DNA-3-methyladenine glycosylase 2 | 1502 |
| L672 | DNA-binding response regulator MtrA | 1503 |
| L673 | DNA-directed RNA polymerase beta chain | 1504 |
| L674 | DNA-directed RNA polymerase beta chain | 1505 |
| L675 | DNA-directed RNA polymerase beta chain | 1506 |
| L676 | DNA-directed RNA polymerase beta chain | 1507 |
| L677 | DNA-directed RNA polymerase beta chain | 1508 |
| L678 | DNA-directed RNA polymerase beta chain | 1509 |
| L679 | DNA-directed RNA polymerase beta chain | 1510 |
| L680 | DNA-directed RNA polymerase beta chain | 1511 |
| L681 | DNA-directed RNA polymerase II 14.2 kDa polypeptide | 1512 |
| L682 | DNA-directed RNA polymerase II 14.2 kDa polypeptide | 1513 |
| L683 | DNA-directed RNA polymerase, subunit E' (rpoe1) | 1514 |
| L684 | DNA-directed RNA polymerase, subunit E' (rpoe1) | 1515 |

TABLE 2-continued

Linkers

| Linker No. | Description | SEQ ID NO |
|---|---|---|
| L685 | DNA-directed RNA polymerases I, II, and III 27 kDa polypeptide | IIP |
| L686 | DNA-directed RNA polymerases I, II, and III 27 kDa polypeptide | 1516 |
| L687 | DNA-directed RNA polymerases I, II, and III 27 kDa polypeptide | 1517 |
| L688 | DNA-directed RNA polymerases I, II, and III 27 kDa polypeptide | 1518 |
| L689 | DNA-directed RNA polymerases I, II, and III 27 kDa polypeptide | 1519 |
| L690 | *Drosophila* neuroglian | 1520 |
| L691 | Dystroglycan | 1521 |
| L692 | Dystrophin | 1522 |
| L693 | Dystrophin | 1523 |
| L694 | Dystrophin | 1524 |
| L695 | Dystrophin | 1525 |
| L696 | Dystrophin | 1526 |
| L697 | Dystrophin | 1527 |
| L698 | Dystrophin | 1528 |
| L699 | E2A DNA-binding protein | 1529 |
| L700 | E2A DNA-binding protein | 1530 |
| L701 | E3 sumo-protein ligase SIZ1 | 1531 |
| L702 | E3 sumo-protein ligase SIZ1 | 1532 |
| L703 | E3 sumo-protein ligase SIZ1 | 1533 |
| L704 | Early switch protein xol-1 2.2k splice form | 1534 |
| L705 | EGF-like module containing mucin-like hormonereceptor-like 2 precursor | 1535 |
| L706 | EGF-like module containing mucin-like hormonereceptor-like 2 precursor | 1536 |
| L707 | Elongation factor 1-gamma 1 | 1537 |
| L708 | Elongation factor 1-gamma 1 | 1538 |
| L709 | Elongation factor g | 1539 |
| L710 | Elongation factor G | 1540 |
| L711 | Elongation factor G | 1541 |
| L712 | Elongation factor G | 1542 |
| L713 | Elongation factor G | 1543 |
| L714 | Elongation factor G | 1544 |
| L715 | Elongation factor G | 1545 |
| L716 | Elongation factor G | 1546 |
| L717 | Elongation factor G | 1547 |
| L718 | Elongation factor G | 1548 |
| L719 | Elongation factor P | 1549 |
| L720 | Elongation factor Ts | 1550 |
| L721 | Elongation factor Ts | 1551 |
| L722 | Elongation factor Ts | 1552 |
| L723 | Elongation factor Tu (ef-Tu) | 1553 |
| L724 | Endoglucanase | 1554 |
| L725 | Endonuclease PI-SceI | 1555 |
| L726 | Endonuclease PI-SceI | 1556 |
| L727 | Endonuclease PI-SceI | 1557 |
| L728 | Endonuclease PI-SceI | 1558 |
| L729 | Endonuclease PI-SceI | 1559 |
| L730 | Endonuclease PI-SceI | 1560 |
| L731 | Endonuclease PI-SceI | 1561 |
| L732 | Endonuclease PI-SceI | 1562 |
| L733 | Endonuclease PI-SceI | 1563 |
| L734 | Enterobactin synthetase component F | 1564 |
| L735 | Enterobactin synthetase component F | 1565 |
| L736 | Enterobactin synthetase component F | 1566 |
| L737 | Enterobactin synthetase component F | 1567 |
| L738 | Enterobactin synthetase component F | 1568 |
| L739 | Enterobactin synthetase component F | 1569 |
| L740 | Enterobactin synthetase component F | 1570 |
| L741 | Enterobactin synthetase component F | 1571 |
| L742 | Enterobactin synthetase component F | 1572 |
| L743 | Enterochelin esterase | 1573 |
| L744 | Epo receptor | EVV |
| L745 | Epo receptor | 1574 |
| L746 | Erythrocyte binding antigen region II | 1575 |
| L747 | Erythrocyte binding antigen region II | 1576 |
| L748 | Erythrocyte binding antigen region II | 1577 |
| L749 | Erythrocyte binding antigen region II | 1578 |
| L750 | Erythrocyte binding antigen region II | 1579 |
| L751 | E-selectin | 1580 |
| L752 | Esterase EstA | SAP |
| L753 | Esterase EstA | 1581 |
| L754 | Esterase EstA | 1582 |
| L755 | Eukaryotic peptide chain release factor GTP-binding subunit | 1583 |
| L756 | Exonuclease I | RQP |
| L757 | Exonuclease I | 1584 |
| L758 | FascIclIn I | SDP |
| L759 | FascIclIn I | 1585 |
| L760 | Fibrillin-1 | 1586 |

TABLE 2-continued

Linkers

| Linker No. | Description | SEQ ID NO |
|---|---|---|
| L761 | Fibrillin-1 | 1587 |
| L762 | Fibrillin-1 | 1588 |
| L763 | Fibrillin-1 | 1589 |
| L764 | Fibrillin-1 | 1590 |
| L765 | Fibronectin | 1591 |
| L766 | Fibronectin | 1592 |
| L767 | Fibronectin | 1593 |
| L768 | Flagellar hook protein FlgE | 1594 |
| L769 | Flagellar hook protein FlgE | 1595 |
| L770 | Flagellar hook protein FlgE | 1596 |
| L771 | Flagellar hook protein FlgE | 1597 |
| L772 | Flagellar hook protein FlgE | 1598 |
| L773 | Flagellar hook protein FlgE | 1599 |
| L774 | Flagellar hook protein FlgE | 1600 |
| L775 | Flavohemoprotein | 1601 |
| L776 | Flexible G/S rich linker | G |
| L777 | Flexible G/S rich linker | S |
| L778 | Flexible G/S rich linker | GG |
| L779 | Flexible G/S rich linker | GS |
| L780 | Flexible G/S rich linker | GGS |
| L781 | Flexible G/S rich linker | GGG |
| L782 | Flexible G/S rich linker | 1602 |
| L783 | Flexible G/S rich linker | 1603 |
| L784 | Flexible G/S rich linker | 1604 |
| L785 | Flexible G/S rich linker | 1605 |
| L786 | Flexible G/S rich linker | 1606 |
| L787 | Flexible G/S rich linker | 1607 |
| L788 | Flexible G/S rich linker | 1608 |
| L789 | Flexible G/S rich linker | 1609 |
| L790 | Flexible G/S rich linker | 1610 |
| L791 | Flexible G/S rich linker | 1611 |
| L792 | Flexible G/S rich linker | 1612 |
| L793 | Flexible G/S rich linker | 1613 |
| L794 | Flexible G/S rich linker | 1614 |
| L795 | Flexible G/S rich linker | 1615 |
| L796 | Focal adhesion kinase 1 | 1616 |
| L797 | FolC bifunctional protein | 1617 |
| L798 | FolC bifunctional protein | 1618 |
| L799 | FolC bifunctional protein | 1619 |
| L800 | FolC bifunctional protein | 1620 |
| L801 | FolC bifunctional protein | 1621 |
| L802 | FolC bifunctioiial protein | 1622 |
| L803 | FolC bifunctional protein | 1623 |
| L804 | FolC bifunctional protein | 1624 |
| L805 | Follistatin | 1625 |
| L806 | Formate dehydrogenase (large subunit) | YDK |
| L807 | Formate dehydrogenase (large subunit) | 1626 |
| L808 | Formate dehydrogenase (large subunit) | 1627 |
| L809 | Formate dehydrogenase (large subunit) | 1628 |
| L810 | Formate dehydrogenase (large subunit) | 1629 |
| L811 | Formate dehydrogenase (large subunit) | 1630 |
| L812 | Formate dehydrogenase (large subunit) | 1631 |
| L813 | Formate dehydrogenase (large subunit) | 1632 |
| L814 | Formate dehydrogenase (large subunit) | 1633 |
| L815 | Formate dehydrogenase (large subunit) | 1634 |
| L816 | Formate dehydrogenase (large subunit) | 1635 |
| L817 | Formate dehydrogenase (large subunit) | 1636 |
| L818 | Formate dehydrogenase(large subunit) | 1637 |
| L819 | Formate dehydrogenase, nitrate-inducible major subunit | 1638 |
| L820 | Formate dehydrogenase, nitrate-inducible, major subunit | 1639 |
| L821 | Formate dehydrogenase, nitrate-inducible, major subunit | 1640 |
| L822 | Formate dehydrogenase, nitrate-inducible, major subunit | 1641 |
| L823 | Formate dehydrogenase, nitrate-inducible, major subunit | 1642 |
| L824 | Formate dehydrogenase, nitrate-inducible, major subunit | 1643 |
| L825 | Formate dehydrogenase, nitrate-inducible, major subunit | 1644 |
| L826 | Formate dehydrogenase, nitrate-inducible, major subunit | 1645 |
| L827 | Formate dehydrogenase, nitrate-inducible, major subunit | 1646 |
| L828 | Formate dehydrogenase, nitrate-inducible, major subunit | 1647 |
| L829 | Formate dehydrogenase, nitrate-inducible, major subunit | 1648 |
| L830 | Formate dehydrogenase, nitrate-inducible, major subunit | 1649 |
| L831 | Formate dehydrogenase, nitrate-inducible, major subunit | 1650 |
| L832 | Formate dehydrogenase, nitrate-inducible, major subunit | 1651 |
| L833 | Fumarylacetoacetate hydrolase | 1652 |
| L834 | Galactose oxidase | GSV |
| L835 | Galactose oxidase | GWK |
| L836 | Galactose oxidase | IAE |

TABLE 2-continued

Linkers

| Linker No. | Description | SEQ ID NO |
|---|---|---|
| L837 | Galactose oxidase | KRQ |
| L838 | Galactose oxidase | QDT |
| L839 | Galactose oxidase | TPN |
| L840 | Galactose oxidase | 1653 |
| L841 | Galactose oxidase | 1654 |
| L842 | Galactose oxidase | 1655 |
| L843 | Galactose oxidase | 1656 |
| L844 | Galactose oxidase | 1657 |
| L845 | Galactose oxidase | 1658 |
| L846 | Galactose oxidase | 1659 |
| L847 | Galactose oxidase | 1660 |
| L848 | Galactose oxidase | 1661 |
| L849 | Galactose oxidase | 1662 |
| L850 | Galactose oxidase | 1663 |
| L851 | Galactose oxidase | 1664 |
| L852 | Galactose oxidase | 1665 |
| L853 | Galactose oxidase | 1666 |
| L854 | Galactose oxidase | 1667 |
| L855 | Galactose oxidase | 1668 |
| L856 | Galactose oxidase | 1669 |
| L857 | Galactose oxidase | 1670 |
| L858 | Galactose oxidase | 1671 |
| L859 | Galactose oxidase | 1672 |
| L860 | Galactose oxidase | 1673 |
| L861 | Galactose oxidase | 1674 |
| L862 | Galactose oxidase | 1675 |
| L863 | Galactose oxidase | 1676 |
| L864 | Gamma B-crystallin | 1677 |
| L865 | Gamma-delta T-cell receptor | 1678 |
| L866 | Gelation factor | DSS |
| L867 | Gelation factor | 1679 |
| L868 | Gelation factor | 1680 |
| L869 | Gelation factor | 1681 |
| L870 | Gene activator alpha | 1682 |
| L871 | Gingipain R | 1683 |
| L872 | Glucodextranase | 1684 |
| L873 | Glucodextranase | 1685 |
| L874 | Glucodextranase | 1686 |
| L875 | Glucosamine-fructose-6-phosphate aminotransferase | YEQ |
| L876 | Glucosamine-fructose-6-phosphate aminotransferase | 1687 |
| L877 | Glucosamine-fructose-6-phosphate aminotransferase | 1688 |
| L878 | Glucosamine-fructose-6-phosphate aminotransferase | 1689 |
| L879 | Glucosamine-fructose-6-phosphate aminotransferase | 1690 |
| L880 | Glucosamine-fructose-6-phosphate aminotransferase | 1691 |
| L881 | Glucosamine-fructose-6-phosphate aminotransferase | 1692 |
| L882 | Glucosamine-fructose-6-phosphate aminotransferase | 1693 |
| L883 | Glucosamine-fructose-6-phosphate aminotransferase | 1694 |
| L884 | Glucosamine-fructose-6-phosphate aminotransferase | 1695 |
| L885 | Glucosamine-fructose-6-phosphate aminotransferase | 1696 |
| L886 | Glucose-1-phosphate adenylyltransferase small subunit | 1697 |
| L887 | Glucose-1-phosphate adenylyltransferase small subunit | 1698 |
| L888 | Glucose-6-phosphate isomerase | KNA |
| L889 | Glucose-6-phosphate isomerase | VGF |
| L890 | Glucose-6-phosphate isomerase | 1699 |
| L891 | Glucose-6-phosphate isomerase | 1700 |
| L892 | Glucose-6-phosphate isomerase, conjectural | 1701 |
| L893 | Glutamate dehydrogenase | 1702 |
| L894 | Glutamate dehydrogenase | 1703 |
| L895 | Glutamate receptor interacting protein | 1704 |
| L896 | Glutamate synthase [NADPH] large chain | 1705 |
| L897 | Glutamate synthase [NADPH] large chain | 1706 |
| L898 | Glutamate synthase [NADPH] large chain | 1707 |
| L899 | Glutamate synthase [NADPH] large chain | 1708 |
| L900 | Glutamate synthase [NADPH] large chain | 1709 |
| L901 | Glutamate synthase [NADPH] large chain | 1710 |
| L902 | Glutamate synthase [NADPH] large chain | 1711 |
| L903 | Glutamine synthetase | 1712 |
| L904 | Glutamine synthetase | 1713 |
| L905 | Glutamyl-tRNA synthetase | 1714 |
| L906 | Glutamyl-tRNA synthetase | 1715 |
| L907 | Glutamyl-tRNA synthetase | 1716 |
| L908 | Glutamyl-tRNA synthetase | 1717 |
| L909 | Glutamyl-tRNA synthetase | 1718 |
| L910 | Glutamyl-tRNA synthetase | 1719 |
| L911 | Glutamyl-tRNA synthetase | 1720 |
| L912 | Glutamyl-tRNA synthetase | 1721 |

TABLE 2-continued

Linkers

| Linker No. | Description | SEQ ID NO |
|---|---|---|
| L913 | Glutaredoxin 2 | 1722 |
| L914 | Glutathione S-transferase | 1723 |
| L915 | Glutathione S-transferase | 1724 |
| L916 | Glutathione S-transferase | 1725 |
| L917 | Glutathione S-transferase 1-6 | 1726 |
| L918 | Glutathione S-transferase A1 | 1727 |
| L919 | Glutathione S-transferase I | NKP |
| L920 | Glutathione S-transferase I | 1728 |
| L921 | Glutathione synthetase | 1729 |
| L922 | Glutathione transferase GST1-4 | 1730 |
| L923 | Glutathione transferase GST1-4 | 1731 |
| L924 | Glutathione transferase sigma class | 1732 |
| L925 | Glvcerol-3-phosphate dehydrogenase [NAD(P)+] | 1733 |
| L926 | Glycine cleavage system transcriptional repressor, putative | 1734 |
| L927 | Glycolipid-anchored surface protein 2 | 1735 |
| L928 | Glycolipid-anchored surface protein 2 | 1736 |
| L929 | Glycyl-tRNA synthetase | KFA |
| L930 | Glycyl-tRNA synthetase | 1737 |
| L931 | Glycyl-tRNA synthetase | 1738 |
| L932 | Glycyl-tRNA synthetase | 1739 |
| L933 | Glycyl-tRNA synthetase | 1740 |
| L934 | Glycyl-tRNA synthetase | 1741 |
| L935 | Glycyl-tRNA synthetase | 1742 |
| L936 | Glycyl-tRNA synthetase | 1743 |
| L937 | Glycyl-tRNA synthetase | 1744 |
| L938 | Glycyl-tRNA synthetase | 1745 |
| L939 | Growth hormone receptor | 1746 |
| L940 | Growth hormone receptor | 1747 |
| L941 | Harmonin | 1748 |
| L942 | HasR protein | 1749 |
| L943 | HasR protein | 1750 |
| L944 | Hemin transport protein HemS | 1751 |
| L945 | Hemin transport protein HemS | 1752 |
| L946 | Hemin transport protein HemS | 1753 |
| L947 | Hemoglobin | 1754 |
| L948 | Hemolytic lectin CEL-iii | 1755 |
| L949 | Hepatocyte nuclear factor 6 | 1756 |
| L950 | Histidyl-tRNA synthetase | 1757 |
| L951 | HNH homing endonuclease | 1758 |
| L952 | HNH homing endonuclease | 1759 |
| L953 | HNH homing endonuclease | 1760 |
| L954 | Homoserine dehydrogenase | 1761 |
| L955 | Homoserine kinase | 1762 |
| L956 | Homoserine kinase | 1763 |
| L957 | Homoserine kinase | 1764 |
| L958 | Homoserine kinase | 1765 |
| L959 | HTH-type transcriptional regulator MqsA (Ygit/B3021) | 1766 |
| L960 | HTH-type transcriptional repressor | 1767 |
| L961 | HTH-type transcriptional repressor YvoA | 1768 |
| L962 | Human IgG1 middle hinge linker | 1769 |
| L963 | Human IgG1 upper hinge linker | 1770 |
| L964 | Human IgG3 middle hinge linker | 1771 |
| L965 | Human IgG3m15 middle hinge linker | 1772 |
| L966 | Human IgG4 lower hinge linker | 1773 |
| L967 | Human IgG4 middle hinge linker | 1774 |
| L968 | Human IgG4 upper hinge linker | 1775 |
| L969 | Hybrid cluster protein | 1776 |
| L970 | Hybrid cluster protein | 1777 |
| L971 | Hybrid cluster protein | 1778 |
| L972 | Hybrid cluster protein | 1779 |
| L973 | Hybrid cluster protein | 1780 |
| L974 | Hypothetical conserved protein, GK1056 | 1781 |
| L975 | Hypothetical membrane spanning protein | 1782 |
| L976 | Hypothetical methylmalonyl-CoA decarboxylase alpha subunit | 1783 |
| L977 | Hypothetical methylmalonyl-CoA decarboxylase alpha subunit | 1784 |
| L978 | Hypothetical methylmalonyl-CoA decarboxylase alpha subunit | 1785 |
| L979 | Hypothetical methylmalonyl-CoA decarboxylase alpha subunit | 1786 |
| L980 | Hypothetical methylmalonyl-CoA decarboxylase alpha subunit | 1787 |
| L981 | Hypothetical methylmalonyl-CoA decarboxylase alpha subunit | 1788 |
| L982 | Hypothetical methylmalonyl-CoA decarboxylase alpha subunit | 1789 |
| L983 | Hypothetical protein | AEP |
| L984 | Hypothetical protein | 1790 |
| L985 | Hypothetical protein APE0525 | PTL |
| L986 | Hypothetical protein APE0525 | 1791 |
| L987 | Hypothetical protein LOC449832 | 1792 |
| L988 | Hypothetical protein LOC449832 | 1793 |

TABLE 2-continued

Linkers

| Linker No. | Description | SEQ ID NO |
|---|---|---|
| L989 | Hypothetical protein PA4388 | 1794 |
| L990 | Hypothetical protein PA5201 | ASE |
| L991 | Hypothetical protein PA5201 | QDP |
| L992 | Hypothetical protein PA5201 | VKL |
| L993 | Hypothetical protein PA5201 | 1795 |
| L994 | Hypothetical protein PA5201 | 1796 |
| L995 | Hypothetical protein PA5201 | 1797 |
| L996 | Hypothetical protein PA5201 | 1798 |
| L997 | Hypothetical protein PA5201 | 1799 |
| L998 | Hypothetical protein PA5201 | 1800 |
| L999 | Hypothetical protein PA5201 | 1801 |
| L1000 | Hypothetical protein PA5201 | 1802 |
| L1001 | Hypothetical protein PA5201 | 1803 |
| L1002 | Hypothetical protein PA5201 | 1804 |
| L1003 | Hypothetical protein PA5201 | 1805 |
| L1004 | Hypothetical protein PA5201 | 1806 |
| L1005 | Hypothetical protein PA5201 | 1807 |
| L1006 | Hypothetical protein PA5201 | 1808 |
| L1007 | Hypothetical protein PA5201 | 1809 |
| L1008 | Hypothetical protein PA5201 | 1810 |
| L1009 | Hypothetical protein PA5201 | 1811 |
| L1010 | Hypothetical protein PA5201 | 1812 |
| L1011 | Hypothetical protein PA5201 | 1813 |
| L1012 | Hypothetical protein PA5201 | 1814 |
| L1013 | Hypothetical protein PH0495 | ASN |
| L1014 | Hypothetical protein PH0495 | 1815 |
| L1015 | Hypothetical protein PH0495 | 1816 |
| L1016 | Hypothetical protein PH0495 | 1817 |
| L1017 | Hypothetical protein PH0495 | 1818 |
| L1018 | Hypothetical protein PH0510 | 1819 |
| L1019 | Hypothetical protein PH0510 | 1820 |
| L1020 | Hypothetical protein PH1313 | 1821 |
| L1021 | Hypothetical protein PH1313 | 1822 |
| L1022 | Hypothetical protein SLR0953 | 1823 |
| L1023 | Hypothetical protein SLR0953 | 1824 |
| L1024 | Hypothetical protein SLR0953 | 1825 |
| L1025 | Hypothetical protein SLR0953 | 1826 |
| L1026 | Hypothetical protein SLR0953 | 1827 |
| L1027 | Hypothetical protein YIGZ | 1828 |
| L1028 | Hypothetical protein YIGZ | 1829 |
| L1029 | Hypothetical protein YJIA | 1830 |
| L1030 | Hypothetical protein YJIA | 1831 |
| L1031 | Hypothetical protein YJIA | 1832 |
| L1032 | Hypothetical protein YJIA | 1833 |
| L1033 | Hypothetical protein YJIA | 1834 |
| L1034 | Hypothetical tRNA/rRNA methyltransferase YJFH | 1835 |
| L1035 | Hypothetical tRNA/rRNA methyltransferase YJFH | 1836 |
| L1036 | IclR transcriptional regulator | 1837 |
| L1037 | IclR transcriptional regulator | 1838 |
| L1038 | IclR transcriptional regulator | 1839 |
| L1039 | IclR transcriptional regulator | 1840 |
| L1040 | Integrase | 1841 |
| L1041 | Interferon, alpha-inducible protein (clone IFI-15k) | 1842 |
| L1042 | Interleukin-1 receptor, type I | AIF |
| L1043 | Interleukin-1 receptor, type I | 1843 |
| L1044 | Interleukin-1 receptor, type I | 1844 |
| L1045 | Interleukin-1 receptor, type I | 1845 |
| L1046 | Interleukin-12 subunit p40 | FFI |
| L1047 | Interleukin-12 subunit p40 | 1846 |
| L1048 | Interleukin-12 subunit p40 | 1847 |
| L1049 | Interleukin-12 subunit p40 | 1848 |
| L1050 | Interleukin-12 subunit p40 | 1849 |
| L1051 | Interleukin-12 subunit p40 | 1850 |
| L1052 | Interleukin-12 subunit p40 | 1851 |
| L1053 | Interleukin-12 subunit p40 | 1852 |
| L1054 | Interletiktn-2 receptor alpha chain | 1853 |
| L1055 | Interleukin-2 receptor alpha chain | 1854 |
| L1056 | Internalin B | VTQ |
| L1057 | Internalin B | 1855 |
| L1058 | Internalin B | 1856 |
| L1059 | Internalin B | 1857 |
| L1060 | Internalin B | 1858 |
| L1061 | Internalin B | 1859 |
| L1062 | Internalin B | 1860 |
| L1063 | Internalin B | 1861 |
| L1064 | Internalin B | 1862 |

TABLE 2-continued

Linkers

| Linker No. | Description | SEQ ID NO |
|---|---|---|
| L1065 | Internalin B | 1863 |
| L1066 | Internalin B | 1864 |
| L1067 | Internalin B | 1865 |
| L1068 | Internalin B | 1866 |
| L1069 | Intimin | SLV |
| L1070 | Intimin | 1867 |
| L1071 | Intimin | 1868 |
| L1072 | Intimin | 1869 |
| L1073 | Intron-encoded DNA endonuclease I-anil | 1870 |
| L1074 | Intron-encoded DNA endonuclease I-anil | 1871 |
| L1075 | Invasin | KST |
| L1076 | Invasin | 1872 |
| L1077 | Invasin | 1873 |
| L1078 | Invasin | 1874 |
| L1079 | Invasin | 1875 |
| L1080 | Invasin | 1876 |
| L1081 | Invasin | 1877 |
| L1082 | Invasin | 1878 |
| L1083 | Invasin | 1879 |
| L1084 | Invasin | 1880 |
| L1085 | Invasin | 1881 |
| L1086 | Invasin | 1882 |
| L1087 | Invasin | 1883 |
| L1088 | Iron hydrogenase 1 | GAE |
| L1089 | Iron hydrogenase 1 | 1884 |
| L1090 | Iron hydrogenase 1 | 1885 |
| L1091 | Iron hydrogenase 1 | 1886 |
| L1092 | Iron hydrogenase 1 | 1887 |
| L1093 | Iron hydrogenase 1 | 1888 |
| L1094 | Iron hydrogenase 1 | 1889 |
| L1095 | Iron hydrogenase 1 | 1890 |
| L1096 | Iron hydrogenase 1 | 1891 |
| L1097 | Iron hydrogenase 1 | 1892 |
| L1098 | Iron hydrogenase 1 | 1893 |
| L1099 | Iron hydrogenase 1 | 1894 |
| L1100 | Iron hydrogenase 1 | 1895 |
| L1101 | Iron hydrogenase 1 | 1896 |
| L1102 | Iron transport protein | 1897 |
| L1103 | Isoflavanone 4'-O-methyltransferase | 1898 |
| L1104 | Isoflavanone 4'-O-methyltransferase | 1899 |
| L1105 | Junctional adhesion molecule 1 | 1900 |
| L1106 | Junctional adhesion molecule 1 | 1901 |
| L1107 | Junctional adhesion molecule 1 | 1902 |
| L1108 | Kanamycin nucleotidyltransferase | 1903 |
| L1109 | Kanamycin nucleotidyltransferase | 1904 |
| L1110 | Kanamycin nucleotidyltransferase | 1905 |
| L1111 | Kanamycin nucleotidyltransferase | 1906 |
| L1112 | Kelch-like protein 11 | 1907 |
| L1113 | Kexin | ISE |
| L1114 | Kexin | 1908 |
| L1115 | Kexin | 1909 |
| L1116 | Kexin | 1910 |
| L1117 | Kexin | 1911 |
| L1118 | Kexin | 1912 |
| L1119 | Kexin | 1913 |
| L1120 | Kexin | 1914 |
| L1121 | Ku70 | 1915 |
| L1122 | Ku70 | 1916 |
| L1123 | Ku70 | 1917 |
| L1124 | Ku70 | 1918 |
| L1125 | Ku80 | 1919 |
| L1126 | Laccase-1 | 1920 |
| L1127 | Laccase-1 | 1921 |
| L1128 | Laccase-1 | 1922 |
| L1129 | Laccase-1 | 1923 |
| L1130 | Laminin | DKC |
| L1131 | L-aspartate dehydrogenase | SAS |
| L1132 | L-aspartate dehydrogenase | 1924 |
| L1133 | L-aspartate dehydrogenase | 1925 |
| L1134 | Leucine dehydrogenase | 1926 |
| L1135 | Leucine dehydrogenase | 1927 |
| L1136 | Light chain of HyHel10 antibody fragment (fab) | 1928 |
| L1137 | Lin2111 protein | 1929 |
| L1138 | Lin2111 protein | 1930 |
| L1139 | Lipopolysaccharide-responsive and beige-like anchor protein | 1931 |
| L1140 | Lipopolysaccharide-responsive and beige-like anchor protein | 1932 |

TABLE 2-continued

Linkers

| Linker No. | Description | SEQ ID NO |
|---|---|---|
| L1141 | Lipovitellin (LV-1N, LV-1C) | 1933 |
| L1142 | Lipovitellin (LV-1N, LV-1C) | 1934 |
| L1143 | Lipovitellin (LV-1N, LV-1C) | 1935 |
| L1144 | Lipovitellin (LV-1N, LV-1C) | 1936 |
| L1145 | Lipovitellin (LV-1N, LV-1C) | 1937 |
| L1146 | Lipoxygenase-1 | 1938 |
| L1147 | Lipoxygenase-1 | 1939 |
| L1148 | Low affinity immunoglobulin gamma Fc region receptor II-A | 1940 |
| L1149 | Luciferase | 1941 |
| L1150 | LysR-type regulatory protein | 1942 |
| L1151 | Macrolide-specific efflux protein MacA | ATE |
| L1152 | Macrolide-specific efflux protein MacA | 1943 |
| L1153 | Macrolide-specific efflux protein MacA | 1944 |
| L1154 | Magnesium transporter, putative | 1945 |
| L1155 | Main hemagglutinin component | 1946 |
| L1156 | Major centromere autoantigen B | 1947 |
| L1157 | Major surface antigen p30 | 1948 |
| L1158 | Major surface antigen p30 | 1949 |
| L1159 | Major vault protein | 1950 |
| L1160 | Major vault protein | 1951 |
| L1161 | Maltose phosphorylase | 1952 |
| L1162 | Maltose phosphorylase | 1953 |
| L1163 | Maltose phosphorylase | 1954 |
| L1164 | Maltose phosphorylase | 1955 |
| L1165 | Maltose phosphorylase | 1956 |
| L1166 | Manganese-dependent inorganic pyrophosphatase | 1957 |
| L1167 | Manganese-dependent inorganic pyrophosphatase | 1958 |
| L1168 | Mannan-binding lectin | 1959 |
| L1169 | Mannan-binding lectin | 1960 |
| L1170 | Mannan-binding lectin | 1961 |
| L1171 | Mannitol dehydrogenase | HNA |
| L1172 | Mannitol dehydrogenase | 1962 |
| L1173 | Membrane cofactor protein | RET |
| L1174 | Membrane cofactor protein | 1963 |
| L1175 | Membrane-associated prostaglandin E synthase-2 | 1964 |
| L1176 | Membrane-associated prostaglandin E synthase-2 | 1965 |
| L1177 | Membrane-associated prostaglandin E synthase-2 | 1966 |
| L1178 | Membrane-associated prostaglandin E synthase-2 | 1967 |
| L1179 | Membrane-associated prostaglandin E synthase-2 | 1968 |
| L1180 | Membrane-bound lytic murein transglycosylase A | 1969 |
| L1181 | Methionyl-tRNA synthetase | 1970 |
| L1182 | Methyl-accepting chemotaxis protein | VRP |
| L1183 | Methyl-accepting chemotaxis protein | 1971 |
| L1184 | Methyl-accepting chemotaxis protein | 1972 |
| L1185 | Methyl-accepting chemotaxis protein | 1973 |
| L1186 | Methyl-coenzyme M reductase | 1974 |
| L1187 | Methyl-coenzyme M reductase | 1975 |
| L1188 | Methyl-coenzyme M reductase | 1976 |
| L1189 | Methyl-coenzyme M reductase | 1977 |
| L1190 | Methylene tetrahydromethanopterin dehydrogenase | 1978 |
| L1191 | Methylene tetrahydromethanopterin dehydrogenase | 1979 |
| L1192 | Mg2+ transporter MgtE | 1980 |
| L1193 | Mg2+ transporter MgtE | 1981 |
| L1194 | Mg2+ transporter MgtE | 1982 |
| L1195 | Mitochondrial aconitase | 1983 |
| L1196 | Mitochondrial aconitase | 1984 |
| L1197 | Modification methylase TaqI | EGK |
| L1198 | Modification methylase TaqI | PAT |
| L1199 | Modification methylase TaqI | 1985 |
| L1200 | Modification methylase TaqI | 1986 |
| L1201 | Modification methylase TaqI | 1987 |
| L1202 | Modification methylase TaqI | 1988 |
| L1203 | Modification methylase TaqI | 1989 |
| L1204 | Modification methylase TaqI | 1990 |
| L1205 | Modification methylase TaqI | 1991 |
| L1206 | Modification methylase TaqI | 1992 |
| L1207 | Multidrag-efflux transporter 1 regulator | 1993 |
| L1208 | Muramoyl-pentapeptide carboxypeptidase | 1994 |
| L1209 | MutL | 1995 |
| L1210 | MutL | 1996 |
| L1211 | MutL | 1997 |
| L1212 | MutL | 1998 |
| L1213 | MutL | 1999 |
| L1214 | MutL | 2000 |
| L1215 | MutL | 2001 |
| L1216 | MutL | 2002 |

TABLE 2-continued

Linkers

| Linker No. | Description | SEQ ID NO |
|---|---|---|
| L1217 | MutL | 2003 |
| L1218 | MutM (Fpg) protein | 2004 |
| L1219 | MutM (Fpg) protein | 2005 |
| L1220 | MutM (Fpg) protein | 2006 |
| L1221 | MutM (Fpg) protein | 2007 |
| L1222 | Myotubularin-related protein 2 | THW |
| L1223 | Myotubularin-related protein 2 | 2008 |
| L1224 | Myotubularin-related protein 2 | 2009 |
| L1225 | Myotubularin-related protein 2 | 2010 |
| L1226 | Myotubularin-related protein 2 | 2011 |
| L1227 | Myotubularin-related protein 2 | 2012 |
| L1228 | N utilization substance protein A | EIP |
| L1229 | N utilization substance protein A | 2013 |
| L1230 | N utilization substance protein A | 2014 |
| L1231 | N utilization substance protein A | 2015 |
| L1232 | N-acetylglucosamine kinase | CAY |
| L1233 | N-acetylglucosamine kinase | ISP |
| L1234 | N-acetylglucosamine kinase | 2016 |
| L1235 | N-acyl-D-glutamate deacylase | 2017 |
| L1236 | N-acyl-D-glutamate deacylase | 2018 |
| L1237 | N-acyl-D-glutamate deacylase | 2019 |
| L1238 | N-acyl-D-glutamate deacylase | 2020 |
| L1239 | N-acyl-D-glutamate deacylase | 2021 |
| L1240 | N-acyl-D-glutamate deacylase | 2022 |
| L1241 | N-acyl-D-glutamate deacylase | 2023 |
| L1242 | NAD-dependent malic enzyme | 2024 |
| L1243 | NAD-dependent malic enzyme | 2025 |
| L1244 | NADH peroxidase | ADT |
| L1245 | NADH peroxidase | AVG |
| L1246 | NADH peroxidase | TLI |
| L1247 | NADH peroxidase | 2026 |
| L1248 | NADH peroxidase | 2027 |
| L1249 | NADH peroxidase | 2028 |
| L1250 | NADH peroxidase | 2029 |
| L1251 | NADH peroxidase | 2030 |
| L1252 | NADH peroxidase | 2031 |
| L1253 | NADH pyrophosphatase | 2032 |
| L1254 | Naphthalene 1,2-dioxygenase alpha subunit | 2033 |
| L1255 | Naphthalene 1,2-dioxygenase alpha subunit | 2034 |
| L1256 | NEDD8-activating enzyme E1 catalytic subunit | 2035 |
| L1257 | NEDD8-activating enzyme E1 regulatory subunit | 2036 |
| L1258 | NEDD8-activating enzyme E1 regulatory subunit | 2037 |
| L1259 | NEDD8-activating enzyme E1 regulatory subunit | 2038 |
| L1260 | Nei endonuclease VIII-Like 1 | 2039 |
| L1261 | Nei endonuclease VIII-Like 1 | 2040 |
| L1262 | Nei endonuclease VIII-Like 1 | 2041 |
| L1263 | Nei endonuclease VIII-Like 1 | 2042 |
| L1264 | Neural cell adhesion molecule 2 | 2043 |
| L1265 | Neural cell adhesion molecule 2 | 2044 |
| L1266 | Neural cell adhesion molecule 2 | 2045 |
| L1267 | Neural cell adhesion molecule 2 | 2046 |
| L1268 | Neural cell adhesion molecule 2 | 2047 |
| L1269 | Neuroplastin | 2048 |
| L1270 | Neuroplastin | 2049 |
| L1271 | Neuroplastin | 2050 |
| L1272 | Neutrophil cytosol factor 1 | 2051 |
| L1273 | Nickel responsive regulator | 2052 |
| L1274 | NifU-like protein 2, chloroplast | 2053 |
| L1275 | Nitric oxide reductase | ILM |
| L1276 | Nitric oxide reductase | 2054 |
| L1277 | Nitric oxide reductase | 2055 |
| L1278 | Nitric oxide reductase | 2056 |
| L1279 | Nitric oxide reductase | 2057 |
| L1280 | Nitric oxide reductase | 2058 |
| L1281 | NK receptor | 2059 |
| L1282 | Nuclear factor of activated t-cells, cytoplasmic2 | 2060 |
| L1283 | Nucleolin RED12 | 2061 |
| L1284 | O-GlcNAcase NagJ | 2062 |
| L1285 | Orange carotenoid protein | EGV |
| L1286 | Orange carotenoid protein | 2063 |
| L1287 | Orange carotenoid protein | 2064 |
| L1288 | Orn/Lys/Arg decarboxylase family protein | LEL |
| L1289 | Orn/Lys/Arg decarboxylase family protein | 2065 |
| L1290 | Orn/Lys/Arg decarboxylase family protein | 2066 |
| L1291 | Orn/Lys/Arg decarboxylase family protein | 2067 |
| L1292 | Orn/Lys/Arg decarboxylase family protein | 2068 |

TABLE 2-continued

Linkers

| Linker No. | Description | SEQ ID NO |
|---|---|---|
| L1293 | Orn/Lys/Arg decarboxylase family protein | 2069 |
| L1294 | Orn/Lys/Arg decarboxylase family protein | 2070 |
| L1295 | Orn/Lys/Arg decarboxylase family protein | 2071 |
| L1296 | Osteoclast-stimulating factor 1 | 2072 |
| L1297 | Oxygen-independent coproporphyrinogen III oxidase | 2073 |
| L1298 | Oxygen-independent coproporphyrinogen III oxidase | 2074 |
| L1299 | Oxygen-independent coproporphyrinogen III oxidase | 2075 |
| L1300 | Oxygen-independent coproporphyrinogen III oxidase | 2076 |
| L1301 | Oxygen-independent coproporphyrinogen III oxidase | 2077 |
| L1302 | Oxygen-independent coproporphyrinogen III oxidase | 2078 |
| L1303 | Oxygen-independent coproporphyrinogen III oxidase | 2079 |
| L1304 | Oxygen-independent coproporphyrinogen III oxidase | 2080 |
| L1305 | Oxygen-independent coproporphyrinogen III oxidase | 2081 |
| L1306 | Oxygen-independent coproporphyrinogen III oxidase | 2082 |
| L1307 | Paraneoplastic encephalomyelitis antigen HuD | 2083 |
| L1308 | Paraneoplastic encephalomyelitis antigen HuD | 2084 |
| L1309 | Penicillin binding protein 4 | 2085 |
| L1310 | Penicillin binding protein 4 | 2086 |
| L1311 | Penicillin binding protein 4 | 2087 |
| L1312 | Penicillin binding protein 4 | 2088 |
| L1313 | Penicillin binding protein 4 | 2089 |
| L1314 | Penicillin binding protein 4 | 2090 |
| L1315 | Penicillin binding protein 4 | 2091 |
| L1316 | Peptide-N(4)-(N-acetyl-beta-D-glucosaminyl)asparagine amidase F | DGV |
| L1317 | Peptide-N(4)-(N-acetyl-beta-D-glucosaminyl)asparagine amidase F | 2092 |
| L1318 | Peptide-N(4)-(N-acetyl-beta-D-glucosaminyl)asparagine amidase F | 2093 |
| L1319 | Peptide-N(4)-(N-acetyl-beta-D-glucosaminyl)asparagine amidase F | 2094 |
| L1320 | Peroxisomal primary amine oxidase | 2095 |
| L1321 | Peroxisomal primary amine oxidase | 2096 |
| L1322 | Peroxisome biogenesis factor 1 | 2097 |
| L1323 | Pesticidial crystal protein Cry2Aa | 2098 |
| L1324 | Pesticidial crystal protein Cry2Aa | 2099 |
| L1325 | Pesticidial crystal protein Cry2Aa | 2100 |
| L1326 | Phase 1 flagellin | DLT |
| L1327 | Phase 1 flagellin | 2101 |
| L1328 | Phase 1 flagellin | 2102 |
| L1329 | Phase 1 flagellin | 2103 |
| L1330 | Phase 1 flagellin | 2104 |
| L1331 | Phase 1 flagellin | 2105 |
| L1332 | Phase 1 flagellin | 2106 |
| L1333 | Phase 1 flagellin | 2107 |
| L1334 | Phase 1 flagellin | 2108 |
| L1335 | Phase 1 flagellin | 2109 |
| L1336 | Phase 1 flagellin | 2110 |
| L1337 | Phase 1 flagellin | 2111 |
| L1338 | Phase 1 flagellin | 2112 |
| L1339 | Phenylalanyl-tRNA synthetase beta chain | LGL |
| L1340 | Phenylalanyl-tRNA synthetase beta chain | 2113 |
| L1341 | Phenylalanyl-tRNA synthetase beta chain | 2114 |
| L1342 | Phenylalanyl-tRNA synthetase beta chain | 2115 |
| L1343 | Phenylalanyl-tRNA synthetase beta chain | 2116 |
| L1344 | Phenylalanyl-tRNA synthetase beta chain | 2117 |
| L1345 | Phenylalanyl-tRNA synthetase beta chain | 2118 |
| L1346 | Phenylalanyl-tRNA synthetase beta chain | 2119 |
| L1347 | Phenylalanyl-tRNA synthetase beta chain | 2120 |
| L1348 | Phenylalanyl-tRNA synthetase beta chain | 2121 |
| L1349 | Phenylalanyl-tRNA synthetase beta chain | 2122 |
| L1350 | Phenylalanyl-tRNA synthetase beta chain | 2123 |
| L1351 | Phenylalanyl-tRNA synthetase beta chain | 2124 |
| L1352 | Phenylalanyl-tRNA synthetase beta chain | 2125 |
| L1353 | Phosphatase | 2126 |
| L1354 | Phosphatase | 2127 |
| L1355 | Phosphatase | 2128 |
| L1356 | Phosphatidylinositol transfer protein Sec14p | YGT |
| L1357 | Phosphatidylinositol transfer protein Sec14p | 2129 |
| L1358 | Phosphatidylinositol transfer protein Sec14p | 2130 |
| L1359 | Phosphatidylserine synthase | 2131 |
| L1360 | Phosphatidylserine synthase | 2132 |
| L1361 | Phosphatidylserine synthase | 2133 |
| L1362 | Phosphoglycolate phosphatase | 2134 |
| L1363 | Phosphoglycolate phosphatase | 2135 |
| L1364 | Phosphoglycolate phosphatase | 2136 |
| L1365 | Phosphoglycolate phosphatase | 2137 |
| L1366 | Phospholipase D | 2138 |
| L1367 | Phospholipase D | 2139 |
| L1368 | Phospholipase D | 2140 |

TABLE 2-continued

Linkers

| Linker No. | Description | SEQ ID NO |
|---|---|---|
| L1369 | Phosphoribosylamine-glycine ligase | 2141 |
| L1370 | Phosphoribosylamine-glycine ligase | 2142 |
| L1371 | Phosphotransferase system, enzyme I | 2143 |
| L1372 | Photosystem II d1 protease | 2144 |
| L1373 | Photosystem II d1 protease | 2145 |
| L1374 | Photosystem II d1 protease | 2146 |
| L1375 | Photosystem II d1 protease | 2147 |
| L1376 | Photosystem II d1 protease | 2148 |
| L1377 | Phthalate dioxygenase reductase | 2149 |
| L1378 | P-hydroxybenzoate hydroxylase | DGL |
| L1379 | P-hydroxybenzoate hydroxylase | IDL |
| L1380 | P-hydroxybenzoate hydroxylase | RLK |
| L1381 | P-hydroxybenzoate hydroxylase | 2150 |
| L1382 | P-hydroxybenzoate hydroxylase | 2151 |
| L1383 | P-hydroxybenzoate hydroxylase | 2152 |
| L1384 | P-hydroxybenzoate hydroxylase | 2153 |
| L1385 | P-hydroxybenzoate hydroxylase | 2154 |
| L1386 | P-hydroxybenzoate hydroxylase | 2155 |
| L1387 | P-hydroxybenzoate hydroxylase | 2156 |
| L1388 | P-hydroxybenzoate hydroxylase | 2157 |
| L1389 | P-hydroxybenzoate hydroxylase | 2158 |
| L1390 | P-hydroxybenzoate hydroxylase | 2159 |
| L1391 | P-hydroxybenzoate hydroxylase | 2160 |
| L1392 | P-hydroxybenzoate hydroxylase | 2161 |
| L1393 | P-hydroxybenzoate hydroxylase | 2162 |
| L1394 | P-hydroxybenzoate hydroxylase | 2163 |
| L1395 | P-hydroxybenzoate hydroxylase | 2164 |
| L1396 | P-hydroxybenzoate hydroxylase | 2165 |
| L1397 | P-hydroxybenzoate hydroxylase | 2166 |
| L1398 | Phytase | LNF |
| L1399 | Phytase | QSN |
| L1400 | Phytase | 2167 |
| L1401 | Phytase | 2168 |
| L1402 | Phytase | 2169 |
| L1403 | Phytase | 2170 |
| L1404 | Phytase | 2171 |
| L1405 | Phytase | 2172 |
| L1406 | Phytase | 2173 |
| L1407 | Phytase | 2174 |
| L1408 | Pirin | LKS |
| L1409 | Pirin | SGE |
| L1410 | Pirin | 2175 |
| L1411 | Pirin | 2176 |
| L1412 | Pirin | 2177 |
| L1413 | Pirin | 2178 |
| L1414 | Pirin | 2179 |
| L1415 | Pirin | 2180 |
| L1416 | Poly(A) polymerase | 2181 |
| L1417 | Poly(A) polymerase | 2182 |
| L1418 | Poly(A) polymerase | 2183 |
| L1419 | Poly(A) polymerase | 2184 |
| L1420 | Poly(A) polymerase | 2185 |
| L1421 | Poly(A) polymerase | 2186 |
| L1422 | Poly(A) polymerase | 2187 |
| L1423 | Poly(A) polymerase | 2188 |
| L1424 | Poly(A) polymerase | 2189 |
| L1425 | Poly(A) polymerase | 2190 |
| L1426 | Poly(A) polymerase | 2191 |
| L1427 | Poly(A) polymerase | 2192 |
| L1428 | Poly(rC)-binding protein 2 | 2193 |
| L1429 | Polymerase x | 2194 |
| L1430 | Polymerase x | 2195 |
| L1431 | Polypeptide N-acetylgalactosaminyltransferase 2 | 2196 |
| L1432 | Polypeptide N-acetylgalactosaminyltransferase 2 | 2197 |
| L1433 | Polyphosphate kinase | 2198 |
| L1434 | Polyphosphate kinase | 2199 |
| L1435 | Polyphosphate kinase | 2200 |
| L1436 | Polypyrimidine tract-binding protein | 2201 |
| L1437 | Porcine pancreatic spasmolytic polypeptide | 2202 |
| L1438 | Possible 3-mercaptopyruvate sulfurtransferase | LFR |
| L1439 | Possible 3-mercaptopyruvate sulfurtransferase | YGM |
| L1440 | Possible 3-mercaptopyruvate sulfurtransferase | 2203 |
| L1441 | Possible 3-mercaptopyruvate sulfurtransferase | 2204 |
| L1442 | Possible 3-mercaptopyruvate sulfurtransferase | 2205 |
| L1443 | Postsynaptic density protein 95 | 2206 |
| L1444 | Postsynaptic density protein 95 | 2207 |

TABLE 2-continued

Linkers

| Linker No. | Description | SEQ ID NO |
|---|---|---|
| L1445 | Predicted sugar phosphatases of the HAD superfamily | IAI |
| L1446 | Predicted sugar phosphatases of the HAD superfamily | 2208 |
| L1447 | Predicted sugar phosphatases of the HAD superfamily | 2209 |
| L1448 | Predicted sugar phosphatases of the HAD superfamily | 2210 |
| L1449 | Predicted sugar phosphatases of the HAD superfamily | 2211 |
| L1450 | Predicted sugar phosphatases of the HAD superfamily | 2212 |
| L1451 | Predicted sugar phosphatases of the HAD superfamily | 2213 |
| L1452 | Predicted sugar phosphatases of the HAD superfamily | 2214 |
| L1453 | Predicted sugar phosphatases of the HAD superfamily | 2215 |
| L1454 | Preprotein translocase SecA | ITF |
| L1455 | Preprotein translocase SecA | LID |
| L1456 | Preprotein translocase SecA | 2216 |
| L1457 | Preprotein translocase SecA | 2217 |
| L1458 | Preprotein translocase SecA | 2218 |
| L1459 | Preprotein translocase SecA | 2219 |
| L1460 | Preprotein translocase SecA | 2220 |
| L1461 | Preprotein translocase SecA | 2221 |
| L1462 | Preprotein translocase SecA | 2222 |
| L1463 | Preprotein translocase SecA | 2223 |
| L1464 | Preprotein translocase SecA | 2224 |
| L1465 | Preprotein translocase SecA | 2225 |
| L1466 | Preprotein translocase SecA | 2226 |
| L1467 | Preprotein translocase SecA | 2227 |
| L1468 | Preprotein translocase SecA | 2228 |
| L1469 | Preprotein translocase SecA | 2229 |
| L1470 | Preprotein translocase SecA | 2230 |
| L1471 | Preprotein translocase SecA | 2231 |
| L1472 | Preprotein translocase SecA | 2232 |
| L1473 | PrfA | ING |
| L1474 | Probable 16s rRNA-processing protein RimM | 2233 |
| L1475 | Probable biphenyl-2,3-diol 1,2-dioxygenase BphC | 2234 |
| L1476 | Probable chorismate mutase | LLA |
| L1477 | Probable chorismate mutase | 2235 |
| L1478 | Probable chorismate mutase | 2236 |
| L1479 | Probable ferredoxin-dependent nitrite reductase NirA | VPL |
| L1480 | Probable ferredoxin-dependent nitrite reductase NirA | WGI |
| L1481 | Probable ferredoxin-dependent nitrite reductase NirA | 2237 |
| L1482 | Probable ferredoxin-dependent nitrite reductase NirA | 2238 |
| L1483 | Probable ferredoxin-dependent nitrite reductase NirA | 2239 |
| L1484 | Probable ferredoxin-dependent nitrite reductase NirA | 2240 |
| L1485 | Probable ferredoxin-dependent nitrite reductase NirA | 2241 |
| L1486 | Probable ferredoxin-dependent nitrite reductase NirA | 2242 |
| L1487 | Probable ferredoxin-dependent nitrite reductase NirA | 2243 |
| L1488 | Probable ferredoxin-dependent nitrite reductase NirA | 2244 |
| L1489 | Probable ferredoxin-dependent nitrite reductase NirA | 2245 |
| L1490 | Probable ferredoxin-dependent nitrite reductase NirA | 2246 |
| L1491 | Probable ferredoxin-dependent nitrite reductase NirA | 2247 |
| L1492 | Probable ferredoxin-dependent nitrite reductase NirA | 2248 |
| L1493 | Probable galactokinase | 2249 |
| L1494 | Probable galactokinase | 2250 |
| L1495 | Probable galactokinase | 2251 |
| L1496 | Probable galactokinase | 2252 |
| L1497 | Probable galactokinase | 2253 |
| L1498 | Probable galactokinase | 2254 |
| L1499 | Probable galactokinase | 2255 |
| L1500 | Probable galactokinase | 2256 |
| L1501 | Probable galactokinase | 2257 |
| L1502 | Probable galactokinase | 2258 |
| L1503 | Probable galactokinase | 2259 |
| L1504 | Probable galactokinase | 2260 |
| L1505 | Probable glutathione S-transferase | 2261 |
| L1506 | Probable GST-related protein | 2262 |
| L1507 | Probable HPr(Ser) kinase/phosphatase | 2263 |
| L1508 | Probable thiosulfate sulfur transferase | 2264 |
| L1509 | Probable thiosulfate sulfur transferase | 2265 |
| L1510 | Probable thiosulfate sulfur transferase | 2266 |
| L1511 | Probable thiosulfate sulfur transferase | 2267 |
| L1512 | Probable thiosulfate sulfur transferase | 2268 |
| L1513 | Probable thiosulfate sulfur transferase | 2269 |
| L1514 | Probable thiosulfate sulfur transferase | 2270 |
| L1515 | Probable thiosulfate sulfur transferase | 2271 |
| L1516 | Probable tRNA pseudouridine synthase D | 2272 |
| L1517 | Probable tRNA pseudouridine synthase D | 2273 |
| L1518 | Probable tRNA pseudouridine synthase D | 2274 |
| L1519 | Probable tRNA pseudouridine synthase D | 2275 |
| L1520 | Probable tRNA pseudouridine synthase D | 2276 |

TABLE 2-continued

Linkers

| Linker No. | Description | SEQ ID NO |
|---|---|---|
| L1521 | Probable tRNA pseudouridine synthase D | 2277 |
| L1522 | Programed cell death protein 8 | SKE |
| L1523 | Programed cell death protein 8 | TLQ |
| L1524 | Programed cell death protein 8 | 2278 |
| L1525 | Programed cell death protein 8 | 2279 |
| L1526 | Programed cell death protein 8 | 2280 |
| L1527 | Programed cell death protein 8 | 2281 |
| L1528 | Programed cell death protein 8 | 2282 |
| L1529 | Programed cell death protein 8 | 2283 |
| L1530 | Programed cell death protein 8 | 2284 |
| L1531 | Programed cell death protein 8 | 2285 |
| L1532 | Programed cell death protein 8 | 2286 |
| L1533 | Programed cell death protein 8 | 2287 |
| L1534 | Programed cell death protein 8 | 2288 |
| L1535 | Programed cell death protein 8 | 2289 |
| L1536 | Programed cell death protein 8 | 2290 |
| L1537 | Programed cell death protein 8 | 2291 |
| L1538 | Programed cell death protein 8 | 2292 |
| L1539 | Programed cell death protein 8 | 2293 |
| L1540 | Programed cell death protein 8 | 2294 |
| L1541 | Programed cell death protein 8 | 2295 |
| L1542 | Proline oxidase | 2296 |
| L1543 | Prolyl-tRNA synthetase | 2297 |
| L1544 | Prostaglandin G/H synthase 1 | PEI |
| L1545 | Prostaglandin G/H synthase 1 | 2298 |
| L1546 | Protease | 2299 |
| L1547 | Protease | 2300 |
| L1548 | Protease | 2301 |
| L1549 | Protease DegS | 2302 |
| L1550 | Protease DegS | 2303 |
| L1551 | Protease DegS | 2304 |
| L1552 | Protease DegS | 2305 |
| L1553 | Protease III | NAR |
| L1554 | Protease III | RNP |
| L1555 | Protease III | 2306 |
| L1556 | Protease III | 2307 |
| L1557 | Protease III | 2308 |
| L1558 | Protease III | 2309 |
| L1559 | Protease III | 2310 |
| L1560 | Protease III | 2311 |
| L1561 | Protease III | 2312 |
| L1562 | Protease III | 2313 |
| L1563 | Protease III | 2314 |
| L1564 | Protease III | 2315 |
| L1565 | Protease III | 2316 |
| L1566 | Protease III | 2317 |
| L1567 | Protease III | 2318 |
| L1568 | Protease III | 2319 |
| L1569 | Protease III | 2320 |
| L1570 | Protease III | 2321 |
| L1571 | Protease III | 2322 |
| L1572 | Protease III | 2323 |
| L1573 | Protease III | 2324 |
| L1574 | Protease III | 2325 |
| L1575 | Protection of telomeres 1 | 2326 |
| L1576 | Protection of telomeres 1 | 2327 |
| L1577 | Protein (CD58) | 2328 |
| L1578 | Protein (CRP1) | 2329 |
| L1579 | Protein (DNA polymerase) | 2330 |
| L1580 | Protein (DNA polymerase) | 2331 |
| L1581 | Protein (DNA polymerase) | 2332 |
| L1582 | Protein (electron transfer flavoprotein) | 2333 |
| L1583 | Protein (electron transfer flavoprotein) | 2334 |
| L1584 | Protein (Ffh) | 2335 |
| L1585 | Protein (Ffh) | 2336 |
| L1586 | Protein (Ffh) | 2337 |
| L1587 | Protein (Ffh) | 2338 |
| L1588 | Protein (Ffh) | 2339 |
| L1589 | Protein (FokI restriction endonuclease) | 2340 |
| L1590 | Protein (FokI restriction endonuclease) | 2341 |
| L1591 | Protein (FokI restriction endonuclease) | 2342 |
| L1592 | Protein (FokI restriction endonuclease) | 2343 |
| L1593 | Protein (FokI restriction endonuclease) | 2344 |
| L1594 | Protein (FokI restriction endonuclease) | 2345 |
| L1595 | Protein (FokI restriction endonuclease) | 2346 |
| L1596 | Protein (FokI restriction endonuclease) | 2347 |

TABLE 2-continued

Linkers

| Linker No. | Description | SEQ ID NO |
|---|---|---|
| L1597 | Protein (FokI restriction endonuclease) | 2348 |
| L1598 | Protein (neural cell adhesion molecule) | 2349 |
| L1599 | Protein (neural cell adhesion molecule) | 2350 |
| L1600 | Protein (neural cell adhesion molecule) | 2351 |
| L1601 | Protein (nine-haem cytochrome c) | FTH |
| L1602 | Protein (nine-haem cytochrome c) | 2352 |
| L1603 | Protein (nine-haem cytochrome c) | 2353 |
| L1604 | Protein (nine-haem cytochrome c) | 2354 |
| L1605 | Protein (nine-haem cytochrome c) | 2355 |
| L1606 | Protein (nine-haem cytochrome c) | 2356 |
| L1607 | Protein (nine-haem cytochrome c) | 2357 |
| L1608 | Protein (nine-haem cytochrome c) | 2358 |
| L1609 | Protein (nine-haem cytochrome c) | 2359 |
| L1610 | Protein (protease/helicase NS3) | 2360 |
| L1611 | Protein (protease/helicase NS3) | 2361 |
| L1612 | Protein (protease/helicase NS3) | 2362 |
| L1613 | Protein (protease/helicase NS3) | 2363 |
| L1614 | Protein disulfide oxidoreductase | 2364 |
| L1615 | Protein disulfide oxidoreductase | 2365 |
| L1616 | Protein disulfide-isomerase A4 | 2366 |
| L1617 | Protein kinase PKR | 2367 |
| L1618 | Protein kinase PKR | 2368 |
| L1619 | Protein TolB | VNK |
| L1620 | Protein TolB | 2369 |
| L1621 | Protein TolB | 2370 |
| L1622 | Protein TolB | 2371 |
| L1623 | Protein TolB | 2372 |
| L1624 | Protein TolB | 2373 |
| L1625 | Protein TolB | 2374 |
| L1626 | Protein translation elongation factor 1A | 2375 |
| L1627 | Protein transport protein Sec24 | DRN |
| L1628 | Protein transport protein Sec24 | 2376 |
| L1629 | Protein transport protein Sec24 | 2377 |
| L1630 | Protein transport protein Sec24 | 2378 |
| L1631 | Protein transport protein Sec24 | 2379 |
| L1632 | Protein transport protein Sec24 | 2380 |
| L1633 | Protein transport protein Sec24 | 2381 |
| L1634 | Protein transport protein Sec24 | 2382 |
| L1635 | Protein transport protein Sec24 | 2383 |
| L1636 | Pseudouridine synthase CBF5 | AIQ |
| L1637 | Pseudouridine synthase CBF5 | 2384 |
| L1638 | Pseudouridine synthase CBF5 | 2385 |
| L1639 | Putative acetylglutamate synthase | 2386 |
| L1640 | Putative acetylglutamate synthase | 2387 |
| L1641 | Putative acetylglutamate synthase | 2388 |
| L1642 | Putative family 31 glucosidase YicI | 2389 |
| L1643 | Putative family 31 glucosidase YicI | 2390 |
| L1644 | Putative family 31 glucosidase YicI | 2391 |
| L1645 | Putative glutathione transferase | 2392 |
| L1646 | Putative glutathione transferase | 2393 |
| L1647 | Putative glutathione transferase | 2394 |
| L1648 | Putative GNTR-family transcriptional regulator | 2395 |
| L1649 | Putative GNTR-family transcriptional regulator | 2396 |
| L1650 | Putative GNTR-family transcriptional regulator | 2397 |
| L1651 | Putative HTH-type transcriptional regulator PH0061 | 2398 |
| L1652 | Putative HTH-type transcriptional regulator PH1519 | 2399 |
| L1653 | Putative HTH-type transcriptional regulator PH1519 | 2400 |
| L1654 | Putative metallopeptidase | 2401 |
| L1655 | Putative N-acetylmannosamine kinase | 2402 |
| L1656 | Putative N-acetylmannosamine kinase | 2403 |
| L1657 | Putative N-acetylmannosamine kinase | 2404 |
| L1658 | Putative NADP oxidoreductase BF3122 | 2405 |
| L1659 | Putative NADP oxidoreductase BF3122 | 2406 |
| L1660 | Putative NADP oxidoreductase BF3122 | 2407 |
| L1661 | Putative NADP oxidoreductase BF3122 | 2408 |
| L1662 | Putative oxidoreductase | 2409 |
| L1663 | Putative secreted alpha-galactosidase | PLP |
| L1664 | Putative secreted alpha-galactosidase | TNG |
| L1665 | Putative secreted alpha-galactosidase | 2410 |
| L1666 | Putative secreted alpha-galactosidase | 2411 |
| L1667 | Putative secreted alpha-galactosidase | 2412 |
| L1668 | Putative tagatose-6-phosphate ketose/aldose isomerase | DKA |
| L1669 | Putative tagatose-6-phosphate ketose/aldose isomerase | 2413 |
| L1670 | Putative tagatose-6-phosphate ketose/aldose isomerase | 2414 |
| L1671 | Putative tagatose-6-phosphate ketose/aldose isomerase | 2415 |
| L1672 | Putative transcriptional regulator GntR | 2416 |

TABLE 2-continued

Linkers

| Linker No. | Description | SEQ ID NO |
|---|---|---|
| L1673 | Putative transcriptional repressor (TetR/AcrR family) | KFR |
| L1674 | Putative transcriptional repressor (TetR/AcrR family) | 2417 |
| L1675 | Putative uncharacterized protein | 2418 |
| L1676 | Putative uncharacterized protein | 2419 |
| L1677 | Putative uncharacterized protein | 2420 |
| L1678 | Putative uncharacterized protein | 2421 |
| L1679 | Putative uncharacterized protein | 2422 |
| L1680 | Putative uncharacterized protein | 2423 |
| L1681 | Putative uncharacterized protein | 2424 |
| L1682 | Putative uncharacterized protein | 2425 |
| L1683 | Putative uncharacterized protein | 2426 |
| L1684 | Pyruvate decarboxylase | CAA |
| L1685 | Pyruvate decarboxylase | 2427 |
| L1686 | Pyruvate decarboxylase | 2428 |
| L1687 | Pyruvate decarboxylase | 2429 |
| L1688 | Pyruvate decarboxylase | 2430 |
| L1689 | Pyruvate decarboxylase | 2431 |
| L1690 | Pyruvate dehydrogenase [lipoamide] kinase isozyme 2, mitochondrial | YVP |
| L1691 | Pyruvate dehydrogenase [lipoamide] kinase isozyme 2, mitochondrial | 2432 |
| L1692 | Pyruvate dehydrogenase [lipoamide] kinase isozyme 2, mitochondrial | 2433 |
| L1693 | Pyruvate dehydrogenase E1 component subunit beta, mitochondrial | 2434 |
| L1694 | Pyruvate dehydrogenase E1 component subunit beta, mitochondrial | 2435 |
| L1695 | Pyruvate dehydrogenase E1 component subunit beta, mitochondrial | 2436 |
| L1696 | Pyruvate phosphate dikinase | FNP |
| L1697 | Pyruvate phosphate dikinase | SAL |
| L1698 | Pyruvate phosphate dikinase | 2437 |
| L1699 | Pyruvate phosphate dikinase | 2438 |
| L1700 | Pyruvate phosphate dikinase | 2439 |
| L1701 | Pyruvate phosphate dikinase | 2440 |
| L1702 | Pyruvate phosphate dikinase | 2441 |
| L1703 | Pyruvate phosphate dikinase | 2442 |
| L1704 | Pyruvate phosphate dikinase | 2443 |
| L1705 | Pyruvate phosphate dikinase | 2444 |
| L1706 | Pyruvate phosphate dikinase | 2445 |
| L1707 | Pyruvate phosphate dikinase | 2446 |
| L1708 | Pyruvate-ferredoxin oxidoreductase | VRL |
| L1709 | Pyruvate-ferredoxin oxidoreductase | 2447 |
| L1710 | Pyruvate-ferredoxin oxidoreductase | 2448 |
| L1711 | Pyruvate-ferredoxin oxidoreductase | 2449 |
| L1712 | Pyruvate-ferredoxin oxidoreductase | 2450 |
| L1713 | Pyruvate-ferredoxin oxidoreductase | 2451 |
| L1714 | Pyruvate-ferredoxin oxidoreductase | 2452 |
| L1715 | Pyruvate-ferredoxin oxidoreductase | 2453 |
| L1716 | Pyruvate-ferredoxin oxidoreductase | 2454 |
| L1717 | Pyruvate-ferredoxin oxidoreductase | 2455 |
| L1718 | Pyruvate-ferredoxin oxidoreductase | 2456 |
| L1719 | Pyruvate-ferredoxin oxidoreductase | 2457 |
| L1720 | Pyruvate-ferredoxin oxidoreductase | 2458 |
| L1721 | Pyruvate-ferredoxin oxidoreductase | 2459 |
| L1722 | Pyruvate-ferredoxin oxidoreductase | 2460 |
| L1723 | Pyruvate-ferredoxin oxidoreductase | 2461 |
| L1724 | Pyruvate-ferredoxin oxidoreductase | 2462 |
| L1725 | Pyruvate-ferredoxin oxidoreductase | 2463 |
| L1726 | Pyruvate-ferredoxin oxidoreductase | 2464 |
| L1727 | Pyruvate-ferredoxin oxidoreductase | 2465 |
| L1728 | Quinohemoprotein amine dehydrogenase 60 kDa subunit | 2466 |
| L1729 | Quinohemoprotein amine dehydrogenase 60 kDa subunit | 2467 |
| L1730 | Quinohemoprotein amine dehydrogenase 60 kDa subunit | 2468 |
| L1731 | Quinohemoprotein amine dehydrogenase 60 kDa subunit | 2469 |
| L1732 | Quinohemoprotein amine dehydrogenase 60 kDa subunit | 2470 |
| L1733 | Quinohemoprotein amine dehydrogenase 60 kDa subunit | 2471 |
| L1734 | Quinohemoprotein amine dehydrogenase 60 kDa subunit | 2472 |
| L1735 | Quinohemoprotein amine dehydrogenase 60 kDa subunit | 2473 |
| L1736 | Quinohemoprotein amine dehydrogenase 60 kDa subunit | 2474 |
| L1737 | Quinohemoprotein amine dehydrogenase 60 kDa subunit | 2475 |
| L1738 | Rag1 | 2476 |
| L1739 | Rag1 | 2477 |
| L1740 | Receptor-type tyrosine-protein phosphatase Mu | 2478 |
| L1741 | Receptor-type tyrosine-protein phosphatase Mu | 2479 |
| L1742 | RecG | 2480 |
| L1743 | RecG | 2481 |
| L1744 | RecG | 2482 |
| L1745 | RecG | 2483 |
| L1746 | RecG | 2484 |
| L1747 | RecG | 2485 |
| L1748 | RecG | 2486 |

TABLE 2-continued

Linkers

| Linker No. | Description | SEQ ID NO |
|---|---|---|
| L1749 | RecG | 2487 |
| L1750 | RecG | 2488 |
| L1751 | RecG | 2489 |
| L1752 | RecG | 2490 |
| L1753 | RecG | 2491 |
| L1754 | Recombination endonuclease VII | 2492 |
| L1755 | Recombining binding protein suppressor of hairless | 2493 |
| L1756 | Restriction endonuclease | ERV |
| L1757 | Restriction endonuclease | 2494 |
| L1758 | Restriction endonuclease | 2495 |
| L1759 | Restriction endonuclease | 2496 |
| L1760 | Retinaldehyde-binding protein 1 | QYP |
| L1761 | Retinaldehyde-binding protein 1 | 2497 |
| L1762 | Retinaldehyde-binding protein 1 | 2498 |
| L1763 | Retinoblastoma pocket | 2499 |
| L1764 | RfcS | ITD |
| L1765 | RfcS | LTE |
| L1766 | RfcS | 2500 |
| L1767 | RfcS | 2501 |
| L1768 | RfcS | 2502 |
| L1769 | RfcS | 2503 |
| L1770 | RfcS | 2504 |
| L1771 | Rhamnogalacturonase B | 2505 |
| L1772 | Rhamnogalacturonase B | 2506 |
| L1773 | Rhamnogalacturonase B | 2507 |
| L1774 | Rhamnogalacturonase B | 2508 |
| L1775 | Rhamnogalacturonase B | 2509 |
| L1776 | Rhodniin | 2510 |
| L1777 | Rhodniin | 2511 |
| L1778 | Riboflavin synthase | 2512 |
| L1779 | Ribonuclease D | 2513 |
| L1780 | Ribonuclease D | 2514 |
| L1781 | Ribonuclease D | 2515 |
| L1782 | Ribonuclease TTHA0252 | 2516 |
| L1783 | Ribonuclease TTHA0252 | 2517 |
| L1784 | Ribonuclease TTHA0252 | 2518 |
| L1785 | Ribonuclease THHA0252 | 2519 |
| L1786 | Ribonuclease TTHA0252 | 2520 |
| L1787 | Ribonuclease TTHA0252 | 2521 |
| L1788 | Ribonucleotide reductase r1 protein | 2522 |
| L1789 | Ribonucleotide reductase r1 protein | 2523 |
| L1790 | Ribonucleotide reductase r1 protein | 2524 |
| L1791 | Ribonucleotide reductase r1 protein | 2525 |
| L1792 | Ribonucleotide reductase r1 protein | 2526 |
| L1793 | Ribonucleotide reductase r1 protein | 2527 |
| L1794 | Ribosome maturation factor RimM | 2528 |
| L1795 | Ribulose-1,5 bisphosphate carboxylase/oxygenase large subunit N-methyltransferase | RHA |
| L1796 | Ribulose-1,5 bisphosphate carboxylase/oxygenase large subunit N-methyltransferase | 2529 |
| L1797 | Rigid extended P-rich | 2530 |
| L1798 | Rigid extended P-rich | 2531 |
| L1799 | Rigid extended P-rich | 2532 |
| L1800 | Rigid extended P-rich | 2533 |
| L1801 | Rigid extended P-rich | 2534 |
| L1802 | Rigid extended P-rich | 2535 |
| L1803 | Rigid extended P-rich | 2536 |
| L1804 | Rigid extended P-rich | 2537 |
| L1805 | Rigid extended P-rich | 2538 |
| L1806 | Rigid extended P-rich | 2539 |
| L1807 | Rigid extended P-rich | 2540 |
| L1808 | Rigid extended P-rich | 2541 |
| L1809 | Rigid extended P-rich | 2542 |
| L1810 | Rigid extended P-rich | 2543 |
| L1811 | Rigid extended P-rich | 2544 |
| L1812 | Rigid helical | 2545 |
| L1813 | Rigid helical | 2546 |
| L1814 | Rigid helical | 2547 |
| L1815 | Rigid helical | 2548 |
| L1816 | Rigid helical | 2549 |
| L1817 | Rigid helical | 2550 |
| L1818 | Rigid helical | 2551 |
| L1819 | Rigid helical | 2552 |
| L1820 | RNA binding domain of rho transcription termination factor | 2553 |
| L1821 | RNA binding protein ZFa | 2554 |
| L1822 | Rob transcription factor | 2555 |

TABLE 2-continued

Linkers

| Linker No. | Description | SEQ ID NO |
|---|---|---|
| L1823 | Rob transcription factor | 2556 |
| L1824 | RP2 lipase | 2557 |
| L1825 | Rubreiythrin | 2558 |
| L1826 | S-adenosylmethionine synthetase | 2559 |
| L1827 | Sarcoplasmic/endoplasmic reticulum calcium ATPase 1 | QFD |
| L1828 | Sarcoplasmic/endoplasmic reticulum calcium ATPase 1 | 2560 |
| L1829 | Sarcoplasmic/endoplasmic reticulum calcium ATPase 1 | 2561 |
| L1830 | Sarcoplasmic/endoplasmic reticulum calcium ATPase 1 | 2562 |
| L1831 | Sarcoplasmic/endoplasmic reticulum calcium ATPase 1 | 2563 |
| L1832 | Sarcoplasmic/endoplasmic reticulum calcium ATPase 1 | 2564 |
| L1833 | Sarcoplasmic/endoplasmic reticulum calcium ATPase 1 | 2565 |
| L1834 | Sarcoplasmic/endoplasmic reticulum calcium ATPase 1 | 2566 |
| L1835 | Sarcoplasmic/endoplasmic reticulum calcium ATPase 1 | 2567 |
| L1836 | Sarcoplasmic/endoplasmic reticulum calcium ATPase 1 | 2568 |
| L1837 | Sarcoplasmic/endoplasmic reticulum calcium ATPase 1 | 2569 |
| L1838 | Sarcoplasmic/endoplasmic reticulum calcium ATPase 1 | 2570 |
| L1839 | Sarcoplasmic/endoplasmic reticulum calcium ATPase 1 | 2571 |
| L1840 | Sarcoplasmic/endoplasmic reticulum calcium ATPase 1 | 2572 |
| L1841 | Sarcoplasmic/endoplasmic reticulum calcium ATPase 1 | 2573 |
| L1842 | Sarcoplasmic/endoplasmic reticulum calcium ATPase 1 | 2574 |
| L1843 | Sarcoplasmic/endoplasmic reticulum calcium ATPase 1 | 2575 |
| L1844 | Sarcoplasmic/endoplasmic reticulum calcium ATPase 1 | 2576 |
| L1845 | Sarcoplasmic/endoplasmic reticulum calcium ATPase 1 | 2577 |
| L1846 | Sarcoplasmic/endoplasmic reticulum calcium ATPase 1 | 2578 |
| L1847 | Sarcoplasmic/endoplasmic reticulum calcium ATPase 1 | 2579 |
| L1848 | Sarcoplasmic/endoplasmic reticulum calcium ATPase 1 | 2580 |
| L1849 | Sarcoplasmic/endoplasmic reticulum calcium ATPase 1 | 2581 |
| L1850 | Sarcoplasmic/endoplasmic reticulum calcium ATPase 1 | 2582 |
| L1851 | Sarcoplasmic/endoplasmic reticulum calcium ATPase 1 | 2583 |
| L1852 | Sarcoplasmic/endoplasmic reticulum calcium ATPase 1 | 2584 |
| L1853 | Scavenger mRNA-decapping enzyme DcpS | ETC |
| L1854 | Scavenger mRNA-decapping enzyme DcpS | NIT |
| L1855 | Scavenger mRNA-decapping enzyme DcpS | 2585 |
| L1856 | Scavenger mRNA-decapping enzyme DcpS | 2586 |
| L1857 | Sec18p (residues 22-210) | 2587 |
| L1858 | Sec18p (residues 22-210) | 2588 |
| L1859 | Sensor protein | 2589 |
| L1860 | Sensor protein | 2590 |
| L1861 | Septum site-determining protein MinC | 2591 |
| L1862 | Serine acetyltransferase | 2592 |
| L1863 | Serine protease/NTPase/helicase NS3 | 2593 |
| L1864 | Serine protease/NTPase/helicase NS3 | 2594 |
| L1865 | Serine protease/NTPase/helicase NS3 | 2595 |
| L1866 | Serine rich linker | 2596 |
| L1867 | Serine rich linker | 2597 |
| L1868 | Serine rich linker | 2598 |
| L1869 | Serine rich linker | 2599 |
| L1870 | Serine rich linker | 2600 |
| L1871 | Serine rich linker | 2601 |
| L1872 | Serine rich linker | 2602 |
| L1873 | Seryl-tRNA synthetase | 2603 |
| L1874 | Sialidase | 2604 |
| L1875 | Sialidase B | SLT |
| L1876 | Sialidase B | VRE |
| L1877 | Sialidase B | 2605 |
| L1878 | Sialidase B | 2606 |
| L1879 | Sialidase B | 2607 |
| L1880 | Sialidase B | 2608 |
| L1881 | Sialidase B | 2609 |
| L1882 | Sialidase B | 2610 |
| L1883 | SIgnal peptIdase I | SRR |
| L1884 | SIgnal peptIdase I | 2611 |
| L1885 | SIgnal peptIdase I | 2612 |
| L1886 | SIgnal peptIdase I | 2613 |
| L1887 | SIgnal peptIdase I | 2614 |
| L1888 | SIgnal peptIdase I | 2615 |
| L1889 | SIgnal peptIdase I | 2616 |
| L1890 | SIgnal peptIdase I | 2617 |
| L1891 | SIgnal peptIdase I | 2618 |
| L1892 | SIgnal peptIdase I | 2619 |
| L1893 | SIgnal peptIdase I | 2620 |
| L1894 | Signal recognition particle protein | 2621 |
| L1895 | Signal transducer and activator of transcription1-alpha/beta | NDE |
| L1896 | Signal transducer and activator of transcription1-alpha/beta | SSF |
| L1897 | Signal transducer and activator of transcription1-alpha/beta | 2622 |
| L1898 | Signal transducer and activator of transcription1-alpha/beta | 2623 |

TABLE 2-continued

Linkers

| Linker No. | Description | SEQ ID NO |
|---|---|---|
| L1899 | Signal transducer and activator of transcription1-alpha/beta | 2624 |
| L1900 | Signal transducer and activator of transcription1-alpha/beta | 2625 |
| L1901 | Signal transduction protein CBL | 2626 |
| L1902 | Signal transduction protein CBL | 2627 |
| L1903 | Similar to RAD54-like | AKP |
| L1904 | Similar to RAD54-like | EYF |
| L1905 | Similar to RAD54-like | RFE |
| L1906 | Similar to RAD54-like | 2628 |
| L1907 | Similar to RAD54-like | 2629 |
| L1908 | Similar to RAD54-like | 2630 |
| L1909 | Similar to RAD54-like | 2631 |
| L1910 | Similar to RAD54-like | 2632 |
| L1911 | Similar to RAD54-like | 2633 |
| L1912 | Similar to RAD54-like | 2634 |
| L1913 | Similar to RAD54-like | 2635 |
| L1914 | Similar to RAD54-like | 2636 |
| L1915 | Similar to RAD54-like | 2637 |
| L1916 | SKD1 protein | LMQ |
| L1917 | SKD1 protein | 2638 |
| L1918 | SKD1 protein | 2639 |
| L1919 | SKD1 protein | 2640 |
| L1920 | SKD1 protein | 2641 |
| L1921 | SKD1 protein | 2642 |
| L1922 | Sll1358 protein | 2643 |
| L1923 | Sll1358 protein | 2644 |
| L1924 | Sll1358 protein | 2645 |
| L1925 | Sll1358 protein | 2646 |
| L1926 | Soluble IFN alpba/beta receptor | 2647 |
| L1927 | Soluble IFN alpha/beta receptor | 2648 |
| L1928 | Sporozoite-specific SAG protein | 2649 |
| L1929 | Staphylococcal accessory regulator a homologue | 2650 |
| L1930 | Staphylococcal nuclease domain-containing protein 1 | 2651 |
| L1931 | Staphylococcal nuclease domain-containing protein 1 | 2652 |
| L1932 | Staphylococcal nuclease domain-containing protein 1 | 2653 |
| L1933 | Staphylococcal nuclease domain-containing protein 1 | 2654 |
| L1934 | Staphylococcal nuclease domain-containing protein 1 | 2655 |
| L1935 | Staphylococcal nuclease domain-containing protein 1 | 2656 |
| L1936 | Stat protein | 2657 |
| L1937 | Stat protein | 2658 |
| L1938 | Stat protein | 2659 |
| L1939 | Stat protein | 2660 |
| L1940 | Stat protein | 2661 |
| L1941 | Stat protein | 2662 |
| L1942 | Stat protein | 2663 |
| L1943 | Stat protein | 2664 |
| L1944 | Stat protein | 2665 |
| L1945 | Stat protein | 2666 |
| L1946 | Stat protein | 2667 |
| L1947 | Stat protein | 2668 |
| L1948 | Stat protein | 2669 |
| L1949 | Stat protein | 2670 |
| L1950 | Stat protein | 2671 |
| L1951 | Subtilisin-like protease | 2672 |
| L1952 | Succinyl-CoA ligase [GDP-forming] alpha-chain, mitochondrial | 2673 |
| L1953 | Succinyl-CoA ligase [GDP-forming] alpha-chain, mitochondrial | 2674 |
| L1954 | Succinyl-CoA ligase [GDP-forming] alpha-chain, mitochondrial | 2675 |
| L1955 | Succinyl-CoA ligase [GDP-forming] alpha-chain, mitochondrial | 2676 |
| L1956 | Succinyl-CoA ligase [GDP-forming] alpha-chain, mitochondrial | 2677 |
| L1957 | Succinyl-CoA ligase [GDP-forming] alpha-chain, mitochondrial | 2678 |
| L1958 | Succinyl-CoA synthetase beta chain | ADG |
| L1959 | Succinyl-CoA synthetase beta chain | RQP |
| L1960 | Succinyl-CoA synthetase beta chain | 2679 |
| L1961 | Succinyl-CoA synthetase beta chain | 2680 |
| L1962 | Succinyl-CoA synthetase beta chain | 2681 |
| L1963 | Succinyl-CoA synthetase beta chain | 2682 |
| L1964 | Succinyl-CoA synthetase beta chain | 2683 |
| L1965 | Succinyl-CoA synthetase beta chain | 2684 |
| L1966 | Succinyl-CoA: 3-ketoacid-coenzyme A transferase | 2685 |
| L1967 | Sulfurtransferase | 2686 |
| L1968 | Superantigen SMEZ-2 | 2687 |
| L1969 | Superoxide dismutase 1 copper chaperone | 2688 |
| L1970 | Surface layer protein | 2689 |
| L1971 | Surface layer protein | 2690 |
| L1972 | Surface layer protein | 2691 |
| L1973 | Surface layer protein | 2692 |
| L1974 | Surface layer protein | 2693 |

TABLE 2-continued

Linkers

| Linker No. | Description | SEQ ID NO |
|---|---|---|
| L1975 | Surface layer protein | 2694 |
| L1976 | Surface layer protein | 2695 |
| L1977 | Surface layer protein | 2696 |
| L1978 | T lymphocyte activation antigen | 2697 |
| L1979 | T lymphocyte activation antigen | 2698 |
| L1980 | T-cell receptor alpha chain C region | 2699 |
| L1981 | Terminal oxygenase component of carbazole | 2700 |
| L1982 | Tetanus neurotoxin | 2701 |
| L1983 | Tetracycline repressor protein class D | 2702 |
| L1984 | The GTP-binding protein Obg | 2703 |
| L1985 | The GTP-binding protein Obg | 2704 |
| L1986 | The GTP-binding protein Obg | 2705 |
| L1987 | The GTP-binding protein Obg | 2706 |
| L1988 | Thioredoxin domain-containing protein 4 | 2707 |
| L1989 | Thioredoxin domain-containing protein 4 | 2708 |
| L1990 | Thiosulfate sulfurtransferase | IDP |
| L1991 | Thiosulfate sulfurtransferase | 2709 |
| L1992 | Thiosulfate sulfurtransferase | 2710 |
| L1993 | Thiosulfate sulfurtransferase | 2711 |
| L1994 | Thiosulfate sulfurtransferase | 2712 |
| L1995 | Threonyl-tRNA synthetase | 2713 |
| L1996 | Threonyl-tRNA synthetase | 2714 |
| L1997 | Threonyl-tRNA synthetase | 2715 |
| L1998 | Threonyl-tRNA synthetase | 2716 |
| L1999 | Threonyl-tRNA synthetase | 2717 |
| L2000 | Threonyl-tRNA synthetase | 2718 |
| L2001 | Threonyl-tRNA synthetase | 2719 |
| L2002 | Threonyl-tRNA synthetase | 2720 |
| L2003 | Threonyl-tRNA synthetase | 2721 |
| L2004 | Threonyl-tRNA synthetase 1 | 2722 |
| L2005 | Threonyl-tRNA synthetase 1 | 2723 |
| L2006 | Threonyl-tRNA synthetase 1 | 2724 |
| L2007 | Threonyl-tRNA synthetase 1 | 2725 |
| L2008 | Threonyl-tRNA synthetase 1 | 2726 |
| L2009 | Threonyl-tRNA synthetase 1 | 2727 |
| L2010 | Threonyl-tRNA synthetase 1 | 2728 |
| L2011 | Threonyl-tRNA synthetase 1 | 2729 |
| L2012 | Thrombospondin 1 | 2730 |
| L2013 | Tick-borne encephalitis virus glycoprotein | 2731 |
| L2014 | Titin | 2732 |
| L2015 | Titin | 2733 |
| L2016 | TLR1789 protein | 2734 |
| L2017 | TLR1789 protein | 2735 |
| L2018 | Topoisomerase I | 2736 |
| L2019 | Topoisomerase I | 2737 |
| L2020 | Toxic shock syndrome toxin-1 | 2738 |
| L2021 | Toxic shock syndrome toxin-1 | 2739 |
| L2022 | Toxic shock syndrome toxin-1 | 2740 |
| L2023 | Toxic shock syndrome toxin-1 | 2741 |
| L2024 | T-plasminogen activator F1-G | VPV |
| L2025 | T-plasminogen activator F1-G | 2742 |
| L2026 | TpsB transporter FhaC | 2743 |
| L2027 | TpsB transporter FhaC | 2744 |
| L2028 | TpsB transporter FhaC | 2745 |
| L2029 | Transcarbamylase | 2746 |
| L2030 | Transcarbamylase | 2747 |
| L2031 | Transcription antiterminator LicT | 2748 |
| L2032 | Transcription elongation factor GreB | 2749 |
| L2033 | Transcription initiation factor IIa gamma chain | 2750 |
| L2034 | Transcription initiation factor IIb | 2751 |
| L2035 | Transcription initiation factor IIb | 2752 |
| L2036 | Transcriptional regulator (NtrC family) | 2753 |
| L2037 | Transcriptional regulator AefR | 2754 |
| L2038 | Transcriptional regulator AefR | 2755 |
| L2039 | Transcriptional regulator AefR | 2756 |
| L2040 | Transcriptional regulator AefR | 2757 |
| L2041 | Transcriptional regulator AefR | 2758 |
| L2042 | Transcriptional regulator, AsnC family | 2759 |
| L2043 | Transcriptional regulator, AsnC family | 2760 |
| L2044 | Transcriptional regulator, AsnC family | 2761 |
| L2045 | Transcriptional regulator, biotin repressor family | 2762 |
| L2046 | Transcriptional regulator, Crp/Fnr family | 2763 |
| L2047 | Transcriptional regulator, GntR family | 2764 |
| L2048 | Transcriptional regulator, HTH_3 family | 2765 |
| L2049 | Transcriptional regulator, HTH_3 family | 2766 |
| L2050 | Transcriptional regulator, HTH_3 family | 2767 |

TABLE 2-continued

Linkers

| Linker No. | Description | SEQ ID NO |
|---|---|---|
| L2051 | Transcriptional regulator, HTH_3 family | 2768 |
| L2052 | Transcriptional regulator, HTH_3 family | 2769 |
| L2053 | Transcriptional regulator, laci family | 2770 |
| L2054 | Transcriptional regulatory protein ZraR | 2771 |
| L2055 | Transcriptional regulatory protein ZraR | 2772 |
| L2056 | Transcriptional regulatory protein ZraR | 2773 |
| L2057 | Transcriptional regulatory protein ZraR | 2774 |
| L2058 | Transcriptional regulatory protein ZraR | 2775 |
| L2059 | Transcriptional regulatory protein ZraR | 2776 |
| L2060 | Transcriptional regulatory protein ZraR | 2777 |
| L2061 | Transferrin receptor protein | VSN |
| L2062 | Transferrin receptor protein | 2778 |
| L2063 | Transferrin receptor protein | 2779 |
| L2064 | Transferrin receptor protein | 2780 |
| L2065 | Transferrin receptor protein | 2781 |
| L2066 | Translation initiation factor 5A | 2782 |
| L2067 | Translation initiation factor 5A | 2783 |
| L2068 | Translation initiation factor 5A | 2784 |
| L2069 | Translation initiation factor IF2/eIF5b | 2785 |
| L2070 | Translation initiation factor IF2/eIF5b | 2786 |
| L2071 | Transposable element mariner, complete CDS | 2787 |
| L2072 | Tricorn protease | 2788 |
| L2073 | Tricorn protease | 2789 |
| L2074 | Tricorn protease | 2790 |
| L2075 | Trigger factor | 2791 |
| L2076 | Trigger factor | 2792 |
| L2077 | Trigger factor | 2793 |
| L2078 | TRNA CCA-adding enzyme | RRI |
| L2079 | TRNA CCA-adding enzyme | 2794 |
| L2080 | TRNA CCA-adding enzyme | 2795 |
| L2081 | TRNA CCA-adding enzyme | 2796 |
| L2082 | TRNA CCA-adding enzyme | 2797 |
| L2083 | TRNA nucleotidyltransferase | 2798 |
| L2084 | TRNA-splicing endonuclease | 2799 |
| L2085 | Tt1467 protein | LEA |
| L2086 | Tt1467 protein | 2800 |
| L2087 | Tumor suppressor p53-binding protein 1 | 2801 |
| L2088 | Tumor suppressor p53-binding protein 1 | 2802 |
| L2089 | Tumor suppressor p53-binding protein 1 | 2803 |
| L2090 | Tumor suppressor p53-binding protein 1 | 2804 |
| L2091 | Type A flavoprotein FprA | 2805 |
| L2092 | Type A flavoprotein FprA | 2806 |
| L2093 | Type A flavoprotein FprA | 2807 |
| L2094 | Type A flavoprotein FprA | 2808 |
| L2095 | Type A flavoprotein FprA | 2809 |
| L2096 | Type I restriction enzyme specificity protein MG438 | QMH |
| L2097 | Type I restriction enzyme specificity protein MG438 | 2810 |
| L2098 | Type I restriction enzyme specificity protein MG438 | 2811 |
| L2099 | Type I restriction-modification enzyme, S subunit | 2812 |
| L2100 | Type I restriction-modification enzyme, S subunit | 2813 |
| L2101 | Type I site-specific restriction-modification system, R (restriction) subunit | 2814 |
| L2102 | Type I site-specific restriction-modification system, R (restriction) subunit | 2815 |
| L2103 | Type I site-specific restriction-modification system, R (restriction) subunit | 2816 |
| L2104 | Type II DNA topoisomerase VI subunit B | 2817 |
| L2105 | Type II DNA topoisomerase VI subunit B | 2818 |
| L2106 | Type II DNA topoisomerase VI subunit B | 2819 |
| L2107 | Type II DNA topoisomerase VI subunit B | 2820 |
| L2108 | Type II DNA topoisomerase VI subunit B | 2821 |
| L2109 | Type II DNA topoisomerase VI subunit B | 2822 |
| L2110 | Type II DNA topoisomerase VI subunit B | 2823 |
| L2111 | Type II DNA topoisomerase VI subunit B | 2824 |
| L2112 | Type II DNA topoisomerase VI subunit B | 2825 |
| L2113 | Type II DNA topoisomerase VI subunit B | 2826 |
| L2114 | Type II DNA topoisomerase VI subunit B | 2827 |
| L2115 | Type VI secretion system component | 2828 |
| L2116 | Type VI secretion system component | 2829 |
| L2117 | Type VI secretion system component | 2830 |
| L2118 | Tyrosine-protein kinase receptor UFO | 2831 |
| L2119 | Tyrosine-protein kinase receptor UFO | 2832 |
| L2120 | Tyrosine-protein kinase ZAP-70 | 2833 |
| L2121 | Tyrosine-protein kinase ZAP-70 | 2834 |
| L2122 | Tyrosyl-DNA phosphodiesterase | 2835 |
| L2123 | Tyrosyl-DNA phosphodiesterase | 2836 |
| L2124 | Ubiquitin carboxyl-terminal hydrolase 7 | 2837 |
| L2125 | UDP-galactopyranose mutase | 2838 |
| L2126 | UDP-galactopyranose mutase | 2839 |

TABLE 2-continued

Linkers

| Linker No. | Description | SEQ ID NO |
|---|---|---|
| L2127 | UDP-galactopyranose mutase | 2840 |
| L2128 | UDP-galactopyranose mutase | 2841 |
| L2129 | UDP-galactopyranose mutase | 2842 |
| L2130 | UDP-glucose dehydrogenase | 2843 |
| L2131 | UDP-N-acetylmuramate-L-alanine ligase | 2844 |
| L2132 | UDP-N-acetylmuramate-L-alanine ligase | 2845 |
| L2133 | UDP-N-acetylmuramoylalanine--D-glutamate ligase | 2846 |
| L2134 | UDP-N-acetylmuramoylalanine--D-glutamate ligase | 2847 |
| L2135 | UDP-N-acetylmuramoylalanine-D-glutamyl-lysine-D-alanyl-D-alanine ligase, MurF protein | 2848 |
| L2136 | UDP-N-acetylmuramoylalanyl-D-glutamate--2,6-diaminopimelate ligase | 2849 |
| L2137 | UDP-N-acetylmuramoylalanyl-D-glutamate--2,6-diaminopimelate ligase | 2850 |
| L2138 | UDP-N-acetylmuramoylalanyl-D-glutamate--2,6-diaminopimelate ligase | 2851 |
| L2139 | UDP-N-acetylmuramoylalanyl-D-glutamate--2,6-diaminopimelate ligase | 2852 |
| L2140 | UDP-N-acetylmuramoylalanyl-D-glutamate--2,6-diaminopimelate ligase | 2853 |
| L2141 | UDP-N-acetylmuramoylalanyl-D-glutamate--2,6-diaminopimelate ligase | 2854 |
| L2142 | UDP-N-acetylmuramoylalanyl-D-glutamate--2,6-diaminopimelate ligase | 2855 |
| L2143 | Uncharacterized conserved protein | 2856 |
| L2144 | Uncharacterized conserved protein | 2857 |
| L2145 | Uncharacterized GST-like protein yfcF | 2858 |
| L2146 | Uncharacterized GST-like proteinprotein | 2859 |
| L2147 | Uncharacterized GST-like proteinprotein | 2860 |
| L2148 | Uncharacterized GST-like proteinprotein | 2861 |
| L2149 | Uncharacterized protein | 2862 |
| L2150 | Uncharacterized protein | 2863 |
| L2151 | Uncharacterized protein BT_1490 | 2864 |
| L2152 | Uncharacterized protein ypfl | TLR |
| L2153 | Uncharacterized protein ypfl | VHP |
| L2154 | Uncharacterized protein ypfl | 2865 |
| L2155 | Uncharacterized protein ypfl | 2866 |
| L2156 | Uncharacterized protein ypfl | 2867 |
| L2157 | Uncharacterized protein ypfl | 2868 |
| L2158 | Uncharacterized protein ypfl | 2869 |
| L2159 | Uncharacterized protein ypfl | 2870 |
| L2160 | Uncharacterized protein ypfl | 2871 |
| L2161 | Uncharacterized protein ypfl | 2872 |
| L2162 | Uncharacterized protein ypfl | 2873 |
| L2163 | Uncharacterized protein ypfl | 2874 |
| L2164 | Uncharacterized protein ypfl | 2875 |
| L2165 | Uncharacterized protein ypfl | 2876 |
| L2166 | Uncharacterized protein ypfl | 2877 |
| L2167 | Uncharacterized protein ypfl | 2878 |
| L2168 | Uncharacterized protein ypfl | 2879 |
| L2169 | Unknown protein | 2880 |
| L2170 | Unknown protein | 2881 |
| L2171 | UPF0131 protein ykqA | 2882 |
| L2172 | UPF0131 protein ykqA | 2883 |
| L2173 | UPF0131 protein ykqA | 2884 |
| L2174 | UPF0348 protein MJ0951 | 2885 |
| L2175 | UPF0348 protein MJ0951 | 2886 |
| L2176 | UPF0348 protein MJ0951 | 2887 |
| L2177 | UPF0348 protein MJ0951 | 2888 |
| L2178 | UPF0348 protein MJ0951 | 2889 |
| L2179 | UPF0348 protein MJ0951 | 2890 |
| L2180 | UPF0348 protein MJ0951 | 2891 |
| L2181 | UPF0348 protein MJ0951 | 2892 |
| L2182 | URE2 protein | 2893 |
| L2183 | Uridine diphospho-N-acetylenolpyruvylglucosaminereductase | TAK |
| L2184 | Uridine diphospho-N-acetylenolpyruvylglucosaminereductase | 2894 |
| L2185 | Uridine diphospho-N-acetylenolpyruvylglucosaminereductase | 2895 |
| L2186 | Uridine diphospho-N-acetylenolpyruvylglucosaminereductase | 2896 |
| L2187 | Uridine diphospho-N-acetylenolpyruvylglucosaminereductase | 2897 |
| L2188 | Urokinase plasminogen activator surface receptor | 2898 |
| L2189 | Urokinase plasminogen activator surface receptor | 2899 |
| L2190 | Vascular cell adhesion molecule-1 | 2900 |
| L2191 | VCP-like ATPase | 2901 |
| L2192 | VCP-like ATPase | 2902 |
| L2193 | Viral CASP8 and FADD-like apoptosis regulator | 2903 |
| L2194 | Vitamin K-dependent protein Z | 2904 |
| L2195 | VP1 protein | 2905 |
| L2196 | V-type ATP synthase alpha chain | 2906 |
| L2197 | Xaa-Pro aminopeptidase | 2907 |
| L2198 | Xaa-Pro aminopeptidase | 2908 |
| L2199 | Xaa-Pro aminopeptidase | 2909 |
| L2200 | Xaa-Pro aminopeptidase | 2910 |
| L2201 | Xanthine dehydrogenase | 2911 |

TABLE 2-continued

Linkers

| Linker No. | Description | SEQ ID NO |
|---|---|---|
| L2202 | Xanthine dehydrogenase | 2912 |
| L2203 | Xanthine dehydrogenase | 2913 |
| L2204 | Xanthine dehydrogenase | 2914 |
| L2205 | X-prolyl dipeptidyl aminopeptidase | KSY |
| L2206 | X-prolyl dipeptidyl aminopeptidase | LDG |
| L2207 | X-prolyl dipeptidyl aminopeptidase | LLE |
| L2208 | X-prolyl dipeptidyl aminopeptidase | TVS |
| L2209 | X-prolyl dipeptidyl aminopeptidase | 2915 |
| L2210 | X-prolyl dipeptidyl aminopeptidase | 2916 |
| L2211 | X-prolyl dipeptidyl aminopeptidase | 2917 |
| L2212 | X-prolyl dipeptidyl aminopeptidase | 2918 |
| L2213 | X-prolyl dipeptidyl aminopeptidase | 2919 |
| L2214 | X-prolyl dipeptidyl aminopeptidase | 2920 |
| L2215 | X-prolyl dipeptidyl aminopeptidase | 2921 |
| L2216 | X-prolyl dipeptidyl aminopeptidase | 2922 |
| L2217 | X-prolyl dipeptidyl aminopeptidase | 2923 |
| L2218 | X-prolyl dipeptidyl aminopeptidase | 2924 |
| L2219 | X-prolyl dipeptidyl aminopeptidase | 2925 |
| L2220 | X-prolyl dipeptidyl aminopeptidase | 2926 |
| L2221 | X-prolyl dipeptidyl aminopeptidase | 2927 |
| L2222 | X-prolyl dipeptidyl aminopeptidase | 2928 |
| L2223 | X-prolyl dipeptidyl aminopeptidase | 2929 |
| L2224 | X-prolyl dipeptidyl aminopeptidase | 2930 |
| L2225 | X-prolyl dipeptidyl aminopeptidase | 2931 |
| L2226 | X-prolyl dipeptidyl aminopeptidase | 2932 |
| L2227 | X-prolyl dipeptidyl aminopeptidase | 2933 |
| L2228 | X-prolyl dipeptidyl aminopeptidase | 2934 |
| L2229 | X-prolyl dipeptidyl aminopeptidase | 2935 |
| L2230 | X-prolyl dipeptidyl aminopeptidase | 2936 |
| L2231 | X-prolyl dipeptidyl aminopeptidase | 2937 |
| L2232 | X-prolyl dipeptidyl aminopeptidase | 2938 |
| L2233 | Xylosidase/arabinosidase | 2939 |
| L2234 | Xylosidase/arabinosidase | 2940 |
| L2235 | Xylosidase/arabinosidase | 2941 |
| L2236 | Xylosidase/arabinosidase | 2942 |
| L2237 | Xylosidase/arabinosidase | 2943 |
| L2238 | Xylosidase/arabinosidase | 2944 |
| L2239 | Xylosidase/arabinosidase | 2945 |
| L2240 | YkoF | 2946 |
| L2241 | YkuI protein | 2947 |

Internal ribosomal entry site (IRES) is a nucleotide sequence (>500 nucleotides) that allows for initiation of translation in the middle of an mRNA sequence (Kim. J. H. et al., 2011 PLoS One (4): e18556; the contents of which are herein incorporated by reference in its entirety). Use of an IRES sequence ensures co-expression of genes before and after the IRES, though the sequence following the IRES may be transcribed and translated at lower levels than the sequence preceding the IRES sequence.

2A peptides are small "self-cleaving" peptides (18-22 amino acids) derived from viruses such as foot-and-mouth disease virus (F2A), porcine teschovirus-1 (P2A). Thoseaasigna virus (T2A), or equine rhinitis A virus (E2A). The 2A designation refers specifically to a region of picornavirus polyproteins that lead to a ribosomal skip at the glycyl-prolyl bond in the C-terminus of the 2A peptide (Kim. J. H. et al., 2011. PLoS One 6(4): e18556; the contents of which are herein incorporated by reference in its entirety). This skip results in a cleavage between the 2A peptide and its immediate downstream peptide. As opposed to IRES linkers, 2A peptides generate stoichiometric expression of proteins flanking the 2A peptide and their shorter length can be advantageous in generating viral expression vectors.

Some payload regions encode linkers comprising furin cleavage sites. Furin is a calcium dependent serine endo-protease that cleaves proteins just downstream of a basic amino acid target sequence (Arg-X-(Arg,Lys)-Arg) (Thomas. G., 2002. Nature Reviews Molecular Cell Biology 3(10); 753-66; the contents of which are herein incorporated by reference in its entirety). Furin is enriched in the trans-golgi network where it is involved in processing cellular precursor proteins. Furin also plays a role in activating a number of pathogens. This activity can be taken advantage of for expression of polypeptides of the invention.

In some embodiments, the payload region may encode one or more linkers comprising cathepsin, matrix metalloproteinases or legumain cleavage sites. Such linkers are described e.g. by Cizeau and Macdonald in International Publication No. WO2008052322, the contents of which are herein incorporated in their entirety. Cathepsins are a family of proteases with unique mechanisms to cleave specific proteins Cathepsin B is a cysteine protease and cathepsin D is an aspartyl protease. Matrix metalloproteinases are a family of calcium-dependent and zinc-containing endopeptidases. Legumain is an enzyme catalyzing the hydrolysis of (-Asn-Xaa-) bonds of proteins and small molecule substrates.

In some embodiments, payload regions may encode linkers that are not cleaved. Such linkers may include a simple amino acid sequence, such as a glycine rich sequence. In some cases, linkers may comprise flexible peptide linkers comprising glycine and serine residues. The linker may comprise flexible peptide linkers of different lengths, e.g. nxG4S, where n=1-10 (SEQ ID NO:9222) and the length of the encoded linker varies between 5 and 50 amino acids. In a non-limiting example, the linker may be 5xG4S (SEQ ID NO: 9221) encoded by SEQ ID NO: 903. These flexible linkers are small and without side chains so they tend not to influence secondary protein structure while providing a flexible linker between antibody segments (George. R. A., et al., 2002. Protein Engineering 15(11): 871-9; Huston, J. S. et al., 1988. PNAS 85:5879-83, and Shan. D. et al., 1999. Journal of Immunology, 162(11):6589-95; the contents of each of which are herein incorporated by reference in their entirety). Furthermore, the polarity of the serine residues improves solubility and prevents aggregation problems.

In some embodiments, payload regions of the invention may encode small and unbranched serine-rich peptide linkers, such as those described by Huston et al, in U.S. Pat. No. 5,525,491, the contents of which are herein incorporated in their entirety Polypeptides encoded by the payload region of the invention, linked by serine-rich linkers, have increased solubility.

In some embodiments, payload regions of the invention may encode artificial linkers, such as those described by Whitlow and Filpula in U.S. Pat. No. 5,856,456 and Ladner et al, in U.S. Pat. No. 4,946,778, the contents of each of which are herein incorporated by their entirety.

Viral Genome Component: Introns

In one embodiment, the payload region comprises at least one element to enhance the expression such as one or more introns or portions thereof. Non-limiting examples of introns include, MVM (67-97 bps), F.IX truncated intron 1 (300 bps), β-globin SD/immunoglobulin heavy chain splice acceptor (250 bps), adenovirus splice donor/immunoglobin splice acceptor (500 bps), SV40 late splice donor/splice acceptor (19S/16S) (180 bps) and hybrid adenovirus splice donor/IgG splice acceptor (230 bps).

In one embodiment, the intron or intron portion may be 100-500 nucleotides in length. The intron may have a length of 80, 90, 100, 110, 120, 130, 140, 150, 160, 170, 171, 172, 173, 174, 175, 176, 177, 178, 179, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490 or 500, The intron may have a length between 80-100, 80-120, 80-140, 80-160, 80-180, 80-200, 80-250, 80-300, 80-350, 80-400, 80-450, 80-500, 200-300, 200-400, 200-500, 300-400, 300-500, or 400-500.

Payloads of the Invention

The AAV particles of the present disclosure comprise at least one payload region. As used herein. "payload" or "payload region" refers to one or more polynucleotides or polynucleotide regions encoded by or within a viral genome or an expression product of such polynucleotide or polynucleotide region, e.g., a transgene, a polynucleotide encoding a polypeptide or multi-polypeptide or a modulatory nucleic acid or regulatory nucleic acid Payloads of the present invention typically encode polypeptides (e.g., antibodies or antibody-based compositions) or fragments or variants thereof.

The payload region may be constructed in such a way as to reflect a region similar to or mirroring the natural organization of an mRNA.

The payload region may comprise a combination of coding and non-coding nucleic acid sequences.

In some embodiments, the AAV payload region may encode a coding or non-coding RNA.

In one embodiment, the AAV particle comprises a viral genome with a payload region comprising nucleic acid sequences encoding more than one polypeptide of interest (e.g., an antibody). In such an embodiment, a viral genome encoding more than one polypeptide may be replicated and packaged into a viral particle. A target cell transduced with a viral particle comprising more than one polypeptide may express each of the polypeptides in a single cell.

In one embodiment, as shown in FIG. 1, an AAV particle comprises a viral genome with a payload region comprising a nucleic acid sequence encoding a heavy chain and a light chain of an antibody. The heavy chain and light chain are expressed and assembled to form the antibody which is secreted.

Figure 2:
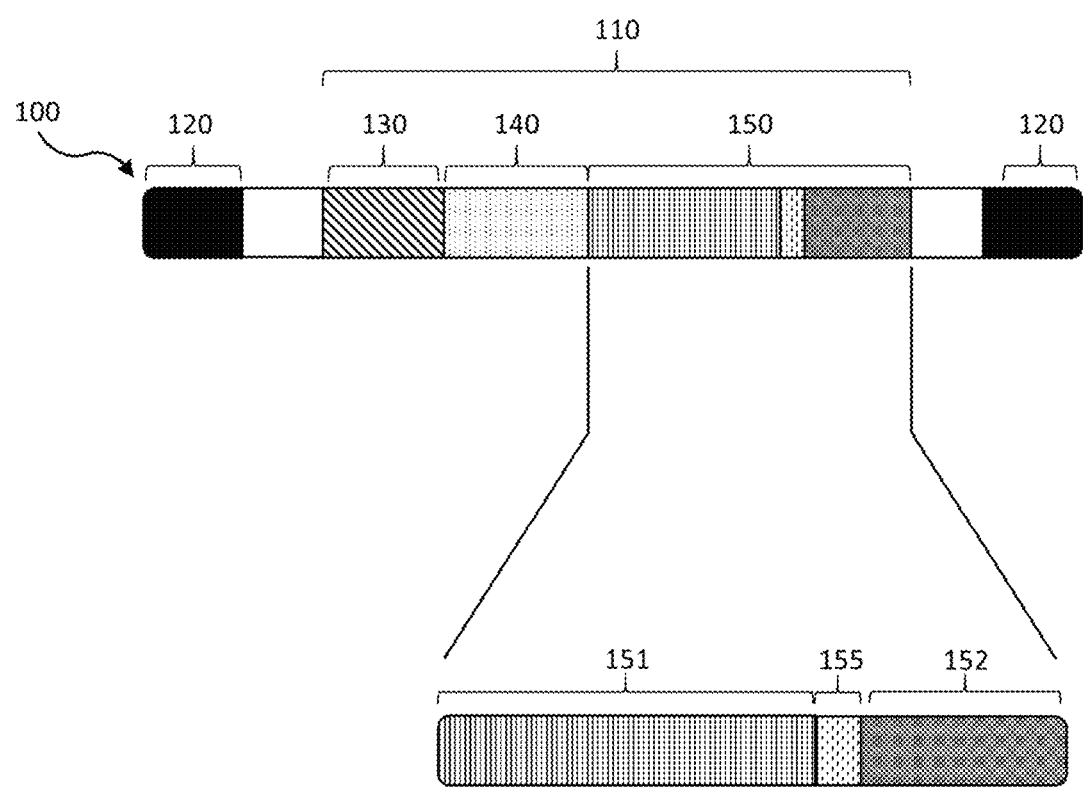
FIG. 2 is a schematic of a viral genome of the invention.

In one embodiment, the payload region may comprise the components as shown in FIG. 2. The payload region 110 is located within the viral genome 100. At the 5' and/or the 3' end of the payload region 110 there may be at least one inverted terminal repeat (ITR) 120. Within the payload region, there is a promoter region 130, an intron region 140 and a coding region 150. When the coding region 150 comprises a heavy chain region 151 and light chain region 152 of an antibody, the two chains may be separated by a linker region 155.

In one embodiment, the coding region may comprise a heavy and light chain sequence and a linker. As shown in FIG. 3, the payload region may comprise a heavy chain and light chain sequence separated by a linker and/or a cleavage site. In one embodiment, the heavy and light chain sequence is sequence separated by an IRES sequence (1 and 2) In one embodiment, the heavy and light chain sequence is separated by a foot and mouth virus sequence (3 and 4). In one embodiment, the heavy and light chain sequence is separated by a foot and mouth virus sequence and a furin cleavage site (5 and 6) In one embodiment, the heavy and light chain sequence is separated by a porcine teschovirus-1 virus sequence (7 and 8) In one embodiment, the heavy and light chain sequence is separated by a porcine teschovirus-1 virus and a furin cleavage site (9 and 10). In one embodiment, the heavy and light chain sequence is separated by a 5xG4S (SEQ ID NO: 9221) sequence (11).

Where the AAV particle payload region encodes a polypeptide, the polypeptide may be a peptide or protein. A protein encoded by the AAV particle payload region may comprise an antibody, an antibody related composition, a secreted protein, an intracellular protein, an extracellular protein, and/or a membrane protein. The encoded proteins may be structural or functional. In addition to the antibodies or antibody-based composition, proteins encoded by the payload region may include, in combination, certain mammalian proteins involved in immune system regulation. The AAV viral genomes encoding polypeptides described herein may be useful in the fields of human disease, viruses, infections veterinary applications and a variety of in vivo and in vitro settings.

In some embodiments, the AAV particles are useful in the field of medicine for the treatment, prophylaxis, palliation or amelioration of neurological diseases and/or disorders.

Antibodies and Antibody-Based Compositions

Payload regions of the AAV particles of the invention may encode polypeptides that form one or more functional antibodies or antibody-based compositions. As used herein, the term "antibody" is referred to in the broadest sense and specifically covers various embodiments including, but not limited to monoclonal antibodies, polyclonal antibodies, multispecific antibodies (e.g. bispecific antibodies formed from at least two intact antibodies), and antibody fragments (e.g., diabodies) so long as they exhibit a desired biological activity (e.g., "functional"). Antibodies are primarily amino-acid based molecules but may also comprise one or more modifications (including, but not limited to the addition of sugar moieties, fluorescent moieties, chemical tags, etc.)

As used herein, "antibody-based" or "antibody-derived" compositions are monomeric or multi-meric polypeptides which comprise at least one amino-acid region derived from a known or parental antibody sequence and at least one amino acid region derived from a non-antibody sequence, e.g., mammalian protein.

Payload regions may encode polypeptides that form or function as any antibody, including antibodies that are known in the art and/or antibodies that are commercially available. The encoded antibodies may be therapeutic, diagnostic, or for research purposes. Further, polypeptides of the invention may include fragments of such antibodies or antibodies that have been developed to comprise one or more of such fragments (e.g., variable domains or complementarity determining regions (CDRs)).

In one embodiment, the viral genome of the AAV particles may comprise nucleic acids which have been engineered to enable expression of antibodies, antibody fragments, or components of any of those described in U.S. Pat. No. 7,041,807 related to YYX epitope; US20090175884, US20110305630, US20130330275 related to misfolded proteins in cancer; US20040175775 related to PrP in eye fluid, US20030114360 related to copolymers and methods of treating prion-related diseases: WO2009121176 insulin-induced gene peptide compositions, US20030022243, WO2003000853 related to protein aggregation assays; WO200078344 related to prion protein peptides and uses thereof. Each of these publications are incorporated by reference in their entireties.

Antibody Generation

In some embodiments, viral genomes of the AAV particles of the invention may encode antibodies or antibody-based compositions produced using methods known in the art. Such methods may include, but are not limited to immunization and display technologies (e.g., phage display, yeast display, and ribosomal display). Antibodies may be developed, for example, using any naturally occurring or synthetic antigen. As used herein, an "antigen" is an entity which induces or evokes an immune response in an organism. An immune response is characterized by the reaction of the cells, tissues and/or organs of an organism to the presence of a foreign entity. Such an immune response typically leads to the production by the organism of one or more antibodies against the foreign entity, e.g., antigen or a portion of the antigen. As used herein. "antigens" also refer to binding partners for specific antibodies or binding agents in a display library.

In one embodiment, the sequences of the polypeptides to be encoded in the viral genomes of the invention may be derived from antibodies produced using hybridoma technology. Host animals (e.g. mice, rabbits, goats, and llamas) may be immunized by an injection with an antigenic protein to elicit lymphocytes that specifically bind to the antigen. Lymphocytes may be collected and fused with immortalized cell lines to generate hybridomas which can be cultured in a suitable culture medium to promote growth. The antibodies produced by the cultured hybridomas may be subjected to analysis to determine binding specificity of the antibodies for the target antigen. Once antibodies with desirable characteristics are identified, corresponding hybridomas may be subcloned through limiting dilution procedures and grown by standard methods. The antibodies produced by these cells may be isolated and purified using standard immunoglobulin purification procedures.

In one embodiment, the sequences of the polypeptides to be encoded in the viral genomes of the invention may be produced using heavy and light chain variable region cDNA sequences selected from hybridomas or from other sources. Sequences encoding antibody variable domains expressed by hybridomas may be determined by extracting RNA molecules from antibody-producing hybridoma cells and producing cDNA by reverse transcriptase polymerase chain reaction (PCR). PCR may be used to amplify cDNA using primers specific for heavy and light chain sequences. PCR products may then be subcloned into plasmids for sequence analysis. Antibodies may be produced by insertion of resulting variable domain sequences into expression vectors.

In one embodiment, the sequences of the polypeptides to be encoded in the viral genomes of the invention may be generated using display technologies. Display technologies used to generate polypeptides of the invention may include any of the display techniques (e.g display library screening techniques) disclosed in International Patent Application No. WO2014074532, the contents of which are herein incorporated by reference in their entirety. In some embodiments, synthetic antibodies may be designed, selected or optimized by screening target antigens using display technologies (e.g. phage display technologies). Phage display libraries may comprise millions to billions of phage particles, each expressing unique antibody fragments on their viral coats. Such libraries may provide richly diverse resources that may be used to select potentially hundreds of antibody fragments with diverse levels of affinity for one or more antigens of interest (McCafferty, et al., 1990. Nature, 348:552-4; Edwards. B. M. et al., 2003. JMB, 334: 103-18; Schofield, D. et al., 2007. Genome Biol. 8. R254 and Pershad, K. et al., 2010 Protein Engineering Design and Selection, 23.279-88; the contents of each of which are herein incorporated by reference in their entirety). Often, the antibody fragments present in such libraries comprise scFv antibody fragments, comprising a fusion protein of $V_H$ and $V_L$ antibody domains joined by a flexible linker. In some cases, scFvs may contain the same sequence with the exception of unique sequences encoding variable loops of the CDRs. In some cases, scFvs are expressed as fusion proteins, linked to viral coat proteins (e.g. the N-terminus of the viral pIII coat protein) $V_L$ chains may be expressed separately for assembly with $V_H$ chains in the periplasm prior to complex incorporation into viral coats. Precipitated library members may be sequenced from the bound phage to obtain cDNA encoding desired scFvs. Antibody variable domains or CDRs from such sequences may be directly incorporated into antibody sequences for recombinant antibody production, or mutated and utilized for further optimization through in vitro affinity maturation.

In one embodiment, the sequences of the polypeptides to be encoded in the viral genomes of the invention may be produced using yeast surface display technology, wherein antibody variable domain sequences may be expressed on the cell surface of *Saccharomyces cerevisiae*. Recombinant antibodies may be developed by displaying the antibody fragment of interest as a fusion to e.g. Aga2p protein on the surface of the yeast, where the protein interacts with proteins and small molecules in a solution, scFvs with affinity towards desired receptors may be isolated from the yeast surface using magnetic separation and flow cytometry. Several cycles of yeast surface display and isolation may be done to attain scFvs with desired properties through directed evolution.

In one embodiment, the sequence of the polypeptides to be encoded in the viral genomes of the invention (e.g., antibodies) may be designed by VERSITOPE™ Antibody Generation and other methods used by BIOATLA® and described in United States Patent Publication No. US20130281303, the contents of which are herein incorporated by reference in their entirety. In brief, recombinant monoclonal antibodies are derived from B-cells of a host immuno-challenged with one or more target antigens. These methods of antibody generation do not rely on immortalized cell lines, such as hybridoma, thereby avoiding some of the associated challenges i.e., genetic instability and low production capacity, producing high affinity and high diversity recombinant monoclonal antibodies. In one embodiment, the method is a natural diversity approach. In another embodiment, the method is a high diversity approach.

In one embodiment, the sequences of the polypeptides to be encoded in the viral genomes of the invention may be generated using BIOATLA® natural diversity approach. In the natural diversity approach of generating recombinant monoclonal antibodies described in United States Patent Publication No. US20130281303, the original pairings of variable heavy ($V_H$) and variable light ($V_L$) domains are retained from the host, yielding recombinant monoclonal antibodies that are naturally paired. These may be advantageous due to a higher likelihood of functionality as compared to non-natural pairings of $V_H$ and $V_L$. To produce the recombinant monoclonal antibodies, first a non-human host (i.e., rabbit, mouse, hamster, guinea pig, camel or goat) is immuno-challenged with an antigen of interest. In some embodiments, the host may be a previously challenged human patient. In other embodiments, the host may not have been immuno-challenged. B-cells are harvested from the host and screened by fluorescence activated cell sorting (FACS), or other method, to create a library of B-cells enriched in B-cells capable of binding the target antigen. The cDNA obtained from the mRNA of a single B-cell is then amplified to generate an immunoglobulin library of $V_H$ and $V_L$ domains. This library of immunoglobulins is then cloned into expression vectors capable of expressing the $V_H$ and $V_L$ domains, wherein the $V_H$ and $V_L$ domains remain naturally paired. The library of expression vectors is then used in an expression system to express the $V_H$ and $V_L$ domains in order to create an antibody library. Screening of the antibody library yields antibodies able to bind the target antigen, and these antibodies can be further characterized. Characterization may include one or more of the following: isoelectric point, thermal stability, sedimentation rate, folding rate, neutralization or antigen activity, antagonist or agonistic activity, expression level, specific and non-specific binding, inhibition of enzymatic activity, rigidity/flexibility, shape, charge, stability across pH, in solvents, under UV radiation, in mechanical stress conditions, or in sonic conditions, half-life and glycosylation.

In one embodiment, the sequences of the polypeptides to be encoded in the viral genomes of the invention may be generated using BIOATLA® high diversity approach. In the high diversity approach of generating recombinant monoclonal antibodies described in United States Patent Publication No. US20130281303, additional pairings of variable heavy ($V_H$) and variable light ($V_L$) domains are attained. To produce the recombinant monoclonal antibodies, B-cells harvested from the host are screened by fluorescence activated cell sorting (FACS), panning, or other method, to create a library of B-cells enriched in B-cells capable of binding the target antigen. The cDNA obtained from the mRNA of the pooled B-cells is then amplified to generate an immunoglobulihn library of $V_H$ and $V_L$ domains. This library of immunoglobulins is then used in a biological display system (mammalian, yeast or bacterial cell surface display systems) to generate a population of cells displaying antibodies, fragments or derivatives comprising the $V_H$ and $V_L$ domains wherein, the antibodies, fragments or derivatives comprise $V_H$ and $V_L$ domain combinations that were not present in the B-cells in vivo. Screening of the cell population by FACS, with the target antigen, yields a subset of cells capable of binding the target antigen and the antibodies displayed on these cells can be further characterized. In an alternate embodiment of the high diversity approach, the immunoglobulin library comprises only $V_H$ domains obtained from the B-cells of the immuno-challenged host, while the $V_L$ domain(s) are obtained from another source.

In one embodiment, the sequences of the polypeptides to be encoded in the viral genomes of the invention may be evolved using BIOATLA® comprehensive approaches. The methods of generating recombinant monoclonal antibodies as described in United States Patent Publication No. US20130281303, further comprises evolving the recombinant antibody by comprehensive positional evolution (CPE™), CPE™ followed by comprehensive protein synthesis (CPS™), PCR shuffling, or other method.

In one embodiment, the sequence of the polypeptides to be encoded in the viral genomes of the invention (e.g., antibodies) may be derived from any of the BIOATLA® protein evolution methods described in International Publication WO2012009026, the contents of which are herein incorporated by reference in their entirety. In this method, mutations are systematically performed throughout the polypeptide or molecule of interest, a map is created providing useful informatics to guide the subsequent evolutionary steps. Not wishing to be bound by theory, these evolutionary methods typically start with a template polypeptide and a mutant is derived therefrom, which has desirable properties or characteristics. Non-limiting examples of evolutionary techniques include polymerase chain reaction (PCR), error prone PCR, oligonucleotide-directed mutagenesis, cassette mutagenesis, shuffling, assembly PCR, sexual PCR mutagenesis, in vivo mutagenesis, site-specific mutagenesis, gene reassembly, gene site saturated mutagenesis, in vitro mutagenesis, ligase chain reaction, oligonucleotide synthesis or any combination thereof.

In one embodiment, the BIOATLA® evolution method is Comprehensive Positional Evolution (CPE™). In CPE, naturally occurring amino acid variants are generated for each of the codons of the template polypeptide, wherein 63 different codon options exist for each amino acid variant. A set of polypeptides with single amino acid mutations are generated and the mutations are then confirmed by sequencing or other method known in the art and each amino acid change screened for improved function, neutral mutations, inhibitory mutations, expression and compatibility with the host system. An EvoMap™ is created that describes in detail the effects of each amino acid mutation on the properties and characteristics of that polypeptide. The data from the EvoMap™ may be utilized to produce polypeptides with more than one amino acid mutation, wherein the resultant multi-site mutant polypeptides can be screened for desirable characteristics.

In one embodiment, the BIOATLA® evolution method is Synergy Evolution, wherein an EvoMap™ is used to identify amino acid positions to introduce 2-20 mutations simultaneously to produce a combinatorial effect. The resulting multi-site mutant polypeptides may be screened on one or more pre-determined characteristics to identify "upmutants" wherein the function of the mutant is improved as compared to the parent polypeptide. In one embodiment, Synergy Evolution is used to enhance binding affinity of an antibody.

In one embodiment, the BIOATLA® evolution method is Flex Evolution, wherein an EvoMap™ is used to identify fully mutable sites within a polypeptide that may then be targeted for alteration, such as introduction of glycosylation sites or chemical conjugation.

In one embodiment, the BIOATLA® evolution method is Comprehensive Positional Insertion Evolution (CPI™), wherein an amino acid is inserted after each amino acid of a template polypeptide to generate a set of lengthened poly peptides. CPI may be used to insert 1, 2, 3, 4, or 5 amino acids at each new position. The resultant lengthened polypeptides are sequenced and assayed for one or more pre-determined properties and evaluated in comparison to its template or parent molecule. In one embodiment, the binding affinity and immunogenicity of the resultant poly peptides are assayed. In one embodiment, the lengthened poly peptides are further mutated and mapped to identify polypeptides with desirable characteristics.

In one embodiment, the BIOATLA® evolution approach is Comprehensive Positional Deletion Evolution (CPD™), wherein each amino acid of the template polypeptide is individually and systematically deleted one at a time. The resultant shortened polypeptides are then sequenced and evaluated by assay for at least one pre-determined feature. In one embodiment, the shortened polypeptides are further mutated and mapped to identify polypeptides with desirable characteristics.

In one embodiment, the BIOATLA® evolution approach is Combinatorial Protein Synthesis (CPS™), wherein mutants identified in CPE, CPI, CPD or other evolutionary technique are combined for polypeptide synthesis. These combined mutant polypeptides are then screened for enhanced properties and characteristics. In one embodiment CPS is combined with any of the aforementioned evolutionary or polypeptide synthesis methods.

In one embodiment, the sequence of the polypeptides to be encoded in the viral genomes of the invention (e.g., antibodies) may be derived from the BIOATLA® Comprehensive Integrated Antibody Optimization (CIAO!™) described in U.S. Pat. No. 8,859,467, the contents of which are herein incorporated by reference in their entirety. The CIAO!™ method allows for simultaneous evolution of polypeptide performance and expression optimization, within a eukaryotic cell host (i.e., mammalian or yeast cell host). First, an antibody library is generated in a mammalian cell production host by antibody cell surface display, wherein the generated antibody library targets a particular antigen of interest. The antibody library is then screened by any method known in the art, for one or more properties or characteristics. One or more antibodies of the library, with desirable properties or characteristics are chosen for further poly peptide evolution by any of the methods known in the art, to produce a library of mutant antibodies by antibody cell surface display in a mammalian cell production host. The generated mutant antibodies are screened for one or more predetermined properties or characteristics, whereby an upmutant is selected, wherein the upmutant has enhanced or improved characteristics as compared to the parent template poly peptide.

In one embodiment, the sequences of the polypeptides to be encoded in the viral genomes of the invention may be humanized by the methods of BIOATLA® as described in United States Patent Publication US20130303399, the contents of which are herein incorporated by reference in their entirety. In this method, for generating enhanced full length humanized antibodies in mammalian cells, no back-mutations are required to retain affinity to the antigen and no CDR grafting or phage-display is necessary. The generated humanized antibody has reduced immunogenicity and equal or greater affinity for the target antigen as compared to the parent antibody. The variable regions or CDRs of the generated humanized antibody are derived from the parent or template, whereas the framework and constant regions are derived from one or more human antibodies. To start, the parent, or template antibody is selected, cloned and each CDR sequence identified and synthesized into a CDR fragment library. Double stranded DNA fragment libraries for $V_H$ and $V_L$ are synthesized from the CDR fragment encoding libraries, wherein at least one CDR fragment library is derived from the template antibody and framework (FW) fragment encoding libraries, wherein the FW fragment library is derived from a pool of human frameworks obtained from natively expressed and functional human antibodies. Stepwise liquid phase ligation of FW and CDR encoding fragments is then used to generate both $V_H$ and $V_L$ fragment libraries. The $V_H$ and $V_L$ fragment libraries are then cloned into expression vectors to create a humanization library, which is further transfected into cells for expression of full length humanized antibodies, and used to create a humanized antibody library. The humanized antibody library is then screened to determine expression level of the humanized antibodies, affinity or binding ability for the antigen, and additional improved or enhanced characteristics, as compared to the template or parent antibody. Non-limiting examples of characteristics that may be screened include equilibrium dissociation constant ($K_D$), stability, melting temperature ($T_m$), pI, solubility, expression level, reduced immunogenicity and improved effector function.

In one embodiment, the sequences of the polypeptides to be encoded in the viral genomes of the invention may be generated by the BIOATLA® method for preparing conditionally active antibodies as described in International Publications WO02016033331 and WO2016036916, the contents of which are herein incorporated by reference in their entirety. As used herein, the term "conditionally active" refers to a molecule that is active at an aberrant condition. Further, the conditionally active molecule may be virtually inactive at normal physiological conditions. Aberrant conditions may result from changes in pH, temperature, osmotic pressure, osmolality, oxidative stress, electrolyte concentration, and/or chemical or proteolytic resistance, as non-limiting examples.

The method of preparing a conditionally active antibody is described in International Publications WO2016033331 and WO2016036916 and summarized herewithin. Briefly, a wild-type polypeptide is selected and the DNA is evolved to create mutant DNAs. Non-limiting examples of evolutionary techniques that may be used to evolve the DNA include polymerase chain reaction (PCR), error prone PCR, shuffling, oligonucleotide-directed mutagenesis, assembly PCR sexual PCR mutagenesis, in vivo mutagenesis, site-specific mutagenesis, gene reassembly, gene site saturated mutagenesis, in vitro mutagenesis, ligase chain reaction, oligonucleotide synthesis or any combination thereof. Once mutant DNAs are created, they are expressed in a eukaryotic cell production host (i.e., fungal, insect, mammalian, adenoviral, plant), wherein a mutant polypeptide is produced. The mutant poly peptide and the corresponding wild-type polypeptide are then subjected to assays under both normal physiological conditions and aberrant conditions in order to identify mutants that exhibit a decrease in activity in the assay at normal physiological conditions as compared to the wild-type polypeptide and/or an increase in activity in the assay under aberrant conditions, as compared to the corresponding wild-type polypeptide. The desired conditionally active mutant may then be produced in the aforementioned eukaryotic cell production host.

In one embodiment, the conditionally active antibody is a "mirac protein" as described by BIOATLA® in U.S. Pat. No. 8,709,755, the contents of which are herein incorporated by reference in their entirety. As used herein "mirac protein" refers to a conditionally active antibody that is virtually inactive at body temperature but active at lower temperatures.

In one embodiment, the sequence of the polypeptides to be encoded in the viral genomes of the invention (e.g., antibodies) may be derived based on any of the BIOATLA™ methods including, but not limited to, VERSITOPE™ Antibody Generation, natural diversity approaches and high diversity approaches for generating monoclonal antibodies, methods for generation of conditionally active polypeptides, humanized antibodies, mirac proteins, multi-specific antibodies or cross-species active mutant polypeptides. Comprehensive Integrated Antibody Optimization (CIAO!®), Comprehensive Positional Evolution (CPE™). Synergy Evolution, Flex Evolution, Comprehensive Positional Insertion Evolution (CPI™). Comprehensive Positional Deletion Evolution (CPD™), Combinatorial Protein Synthesis (CPS®), or any combination thereof. These methods are described in U.S. Pat. Nos. 8,859,467 and 8,709,755 and United States Publication Nos US20130281303, US20130303399, US20150065690, US20150252119, US20150086562 and US20100138945, and International Publication Nos. WO201505888, WO2012009026, WO2011109726, WO2016036916, and WO2016033331, the contents of each of which are herein incorporated by reference in their entirety.

Antibody Fragments and Variants

In some embodiments, antibody fragments encoded by payloads of the invention comprise antigen binding regions from intact antibodies. Examples of antibody fragments may include, but are not limited to Fab, Fab', F(ab')$_2$, and Fv fragments; diabodies; linear antibodies; single-chain antibody molecules; and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')$_2$ fragment that has two antigen-binding sites and is still capable of cross-linking antigen. Compounds and/or compositions of the present invention may comprise one or more of these fragments. For the purposes herein, an "antibody" may comprise a heavy and light variable domain as well as an Fc region.

In one embodiment, the Fc region may be a modified Fc region, as described in US Patent Publication US20150065690, wherein the Fc region may have a single amino acid substitution as compared to the corresponding sequence for the wild-type Fc region, wherein the single amino acid substitution yields an Fc region with preferred properties to those of the wild-type Fc region. Non-limiting examples of Fc properties that may be altered by the single amino acid substitution include bind properties or response to pH conditions As used herein, the term "native antibody" refers to a usually heterotetrameric glycoprotein of about 150,000 Daltons, composed of two identical light (L) chains and two identical heavy (H) chains. Genes encoding antibody heavy and light chains are known and segments making up each have been well characterized and described (Matsuda, F. et al., 1998. The Journal of Experimental Medicine, 188(11); 2151-62 and Li. A. et al., 2004. Blood, 103(12, 4602-9, the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarity determining regions (CDRs) that become part of the antigen-binding site of the antibody. As used herein, the term "CDR" refers to a region of an antibody comprising a structure that is complimentary to its target antigen or epitope Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments can also be used based on comparisons with other antibodies (Strohl, W. R. Therapeutic Antibody Engineering. Woodhead Publishing, Philadelphia Pa. 2012 Ch. 3, p 47-54, the contents of which are herein incorporated by reference in their entirety). Determining residues making up CDRs may include the use of numbering schemes including, but not limited to, those taught by Kabat [Wu. T. T. et al., 1970, JEM, 132(2):211-50 and Johnson, G. et al., 2000, Nucleic Acids Res. 28(1): 214-8, the contents of each of which are herein incorporated by reference in their entirety], Chothia [Chothia and Lesk. J. Mol Biol 196, 901 (1987), Chothia et al., Nature 342, 877 (1989) and Al-Lazikani, B. et al., 1997, J. Mol. Biol. 273(4):927-48, the contents of each of which are herein incorporated by reference in their entirety], Lefranc (Lefranc, M. P. et al., 2005, Immunome Res 1:3) and Honegger (Honegger, A. and Pluckthun, A. 2001. J. Mol. Biol. 309(3):657-70, the contents of which are herein incorporated by reference in their entirety).

$V_H$ and $V_L$ domains have three CDRs each. $V_L$ CDRs are referred to herein as CDR-L1, CDR-L2 and CDR-L3, in order of occurrence when moving from N- to C-terminus along the variable domain polypeptide. $V_H$ CDRs are referred to herein as CDR-H1, CDR-H2 and CDR-H3, in order of occurrence when moving from N- to C-terminus along the variable domain polypeptide. Each of CDRs have favored canonical structures with the exception of the CDR-H3, which comprises amino acid sequences that may be highly variable in sequence and length between antibodies resulting in a variety of three-dimensional structures in antigen-binding domains (Nikoloudis, D. et al., 2014 Peer J 2:e456; the contents of which are herein incorporated by reference in their entirety). In some cases. CDR-H3s may be analyzed among a panel of related antibodies to assess antibody, diversity. Various methods of determining CDR sequences are known in the art and may be applied to known antibody sequences (Strohl. W. R. Therapeutic Antibody Engineering. Woodhead Publishing, Philadelphia Pa. 2012. Ch. 3, p 47-54, the contents of which are herein incorporated by reference in their entirety).

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain [to form a single chain F, (scFv)] or through the introduction of a disulfide bridge between heavy and light chain variable domains (Strohl, W. R. Therapeutic Antibody Engineering Woodhead Publishing. Philadelphia Pa. 2012 Ch. 3, p 46-47, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

As used herein, the term "single chain Fv" or "scFv" refers to a fusion protein of $V_H$ and $V_L$ antibody domains, wherein these domains are linked together into a single polypeptide chain by a flexible peptide linker. In some embodiments, the Fv polypeptide linker enables the scFv to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a given antigen.

As used herein, the term "bispecific antibody" refers to an antibody capable of binding two different antigens. Such antibodies typically comprise regions from at least two different antibodies. Bispecific antibodies may include any of those described in Riethmuller, G, 2012. Cancer Immunity, 12:12-18, Marvin, J. S. et al., 2005. Acta Pharmacologica Sinuca, 26(6).649-58 and Schaefer, W. et al., 2011. PNAS. 108(27) 11187-92, the contents of each of which are herein incorporated by reference in their entirety.

As used herein, the term "diabody" refers to a small antibody fragment with two antigen-binding sites. Diabodies comprise a heavy chain variable domain $V_H$ connected to a light chain variable domain $V_L$ in the same polypeptide chain. By using a linker that is too short to allow pairing between the two domains on the same chain, the domains are forced to pair with the complementary domains of another chain and create two antigen-binding sites. Diabodies are described more fully in, for example EP 404,097; WO 93/11161; and Hollinger et al. (Hollinger, P. et al., "Diabodies" Small bivalent and bispecific antibody fragments. PNAS. 1993, 90:6444-8) the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity.

In some embodiments, viral genomes of the present invention may encode antibody, mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. Nos. 6,673, 901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgE, IgG$_1$, IgG$_2$, IgG$_3$, IgG$_4$, or IgM), humanized variants, optimized variants, multispecific antibody variants (e.g., bispecific variants), and antibody fragments.

The preparation of antibodies, whether monoclonal or polyclonal, is known in the art. Techniques for the production of antibodies are well known in the art and described, e.g. in Harlow and Lane "Antibodies. A Laboratory Manual", Cold Spring Harbor Laboratory Press, 1988, Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

Multispecific Antibodies

In some embodiments, payloads of the invention may encode antibodies that bind more than one epitope. As used herein, the terms "multibody" or "multispecific antibody" refer to an antibody wherein two or more variable regions bind to different epitopes. The epitopes may be on the same or different targets. In certain embodiments, a multi-specific antibody is a "bispecific antibody," which recognizes two different epitopes on the same or different antigens.

In one embodiment, multi-specific antibodies may be prepared by the methods used by BIOATLA® and described in International Patent publication WO201109726, the contents of which are herein incorporated by reference in their entirety. First a library of homologous, naturally occurring antibodies is generated by any method known in the art (i.e., mammalian cell surface display), then screened by FACSAria or other screening method, for multi-specific antibodies that specifically bind to two or more target antigens. In one embodiment, the identified multi-specific antibodies are further evolved by any method known in the art, to produce a set of modified multi-specific antibodies. These modified multi-specific antibodies are screened for binding to the target antigens. In one embodiment, the multi-specific antibody may be further optimized by screening the evolved modified multi-specific antibodies for optimized or desired characteristics.

In one embodiment, multi-specific antibodies may be prepared by the methods used by BIOATLA® and described in Unites States Publication No. US20150252119, the contents of which are herein incorporated by reference in their entirety. In one approach, the variable domains of two parent antibodies, wherein the parent antibodies are monoclonal antibodies are evolved using any method known in the art in a manner that allows a single light chain to functionally complement heavy chains of two different parent antibodies. Another approach requires evolving the heavy chain of a single parent antibody to recognize a second target antigen. A third approach involves evolving the light chain of a parent antibody so as to recognize a second target antigen. Methods for polypeptide evolution are described in International Publication WO2012009026, the contents of which are herein incorporated by reference in their entirety, and include as non-limiting examples. Comprehensive Positional Evolution (CPE), Combinatorial Protein Synthesis (CPS). Comprehensive Positional Insertion (CPI), Comprehensive Positional Deletion (CPD), or any combination thereof. The Fc region of the multi-specific antibodies described in United States Publication No. US20150252119 may be created using a knob-in-hole approach, or any other method that allows the Fc domain to form heterodimers. The resultant multi-specific antibodies may be further evolved for improved characteristics or properties such as binding affinity for the target antigen.

Bispecific Antibodies

In some embodiments, payloads of the invention may encode bispecific antibodies. Bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen.

In some cases, payloads encode bispecific antibodies comprising antigen-binding regions from two different anti-tau antibodies. For example, such bispecific antibodies may comprise binding regions from two different antibodies selected from Tables 3-42. Bispecific antibody frameworks may include any of those described in Riethmuller, G., 2012. Cancer Immunity, 12:12-18; Marvin, J. S. et al., 2005. Acta Pharmacologica Sinica, 26(6):649-58, and Schaefer, W. et al., 2011. PNAS. 108(27); 11187-92, the contents of each of which are herein incorporated by reference in their entirety.

New generations of BsMAb, called "trifunctional bispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

Of the two paratopes that form the tops of the variable domains of a bispecific antibody, one can be directed against a target antigen and the other against a T-lymphocytes antigen like CD3. In the case of trifunctional antibodies, the Fc region may additionally bind to a cell that expresses Fc receptors, like a macrophage, a natural killer (NK) cell or a dendritic cell. In sum, the targeted cell is connected to one or two cells of the immune system, which subsequently destroy it.

Other types of bispecific antibodies have been designed to overcome certain problems, such as short half-life, immunogenicity and side-effects caused by cytokine liberation. They include chemically linked Fabs, consisting only of the Fab regions, and various types of bivalent and trivalent single-chain variable fragments (scFvs), fusion proteins mimicking the variable domains of two antibodies. The furthest developed of these newer formats are the bi-specific T-cell engagers (BuTEs) and mAb2's, antibodies engineered to contain an Fcab antigen-binding fragment instead of the Fc constant region.

Using molecular genetics, two scFvs can be engineered in tandem into a single polypeptide, separated by a linker domain, called a "tandem scFv" (tascFv). TascFvs have been found to be poorly soluble and require refolding when produced in bacteria, or they may be manufactured in mammalian cell culture systems, which avoids refolding requirements but may result in poor yields. Construction of a tascFv with genes for two different scFvs yields a "bispecific single-chain variable fragments" (bis-scFvs). Only two tascFvs have been developed clinically by commercial firms, both are bispecific agents in active early phase development by Micromet for oncologic indications, and are described as "Bispecific T-cell Engagers (BiTE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase 1. Bispecific, tetravalent "TandAbs" are also being researched by Affimed (Nelson, A. L., *MAbs.* 2010. January-February, 2(1):77-83).

In some embodiments, payloads may encode antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions ($V_{HHS}$) of heavy chain antibodies found in camels and llamas, which lack light chains (Nelson. A. L., *MAbs.* 2010 January-February; 2(1):77-83).

Disclosed and claimed in PCT Publication WO02014144573 to Memorial Sloan-Kettering Cancer Center are multimerization technologies for making dimeric multispecific binding agents (e.g., fusion proteins comprising antibody components) with improved properties over multispecific binding agents without the capability of dimerization.

In some cases, payloads of the invention may encode tetravalent bispecific antibodies (TetBiAbs as disclosed and claimed in PCT Publication WO2014144357) TetBiAbs feature a second pair of Fab fragments with a second antigen specificity attached to the C-terminus of an antibody, thus providing a molecule that is bivalent for each of the two antigen specificities. The tetravalent antibody is produced by genetic engineering methods, by linking an antibody heavy chain covalently to a Fab light chain, which associates with its cognate, co-expressed Fab heavy chain.

In some aspects, payloads of the invention may encode biosynthetic antibodies as described in U.S. Pat. No. 5,091,513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic $V_H$ and $V_L$ dimers, 2) $V_H$-$V_L$ or $V_L$-$V_H$ single chains wherein the $V_H$ and $V_L$ are attached by a polypeptide linker, or 3) individuals $V_H$ or $V_L$ domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, payloads may encode antibodies with antibody acceptor frameworks taught in U.S. Pat. No. 8,399,625. Such antibody acceptor frameworks may be particularly well suited accepting CDRs from an antibody of interest. In some cases. CDRs from anti-tau antibodies known in the art or developed according to the methods presented herein may be used.

Miniaturized Antibody

In one embodiment, the antibody encoded by the payloads of the invention may be a "miniaturized" antibody. Among the best examples of mAb miniaturization are the small modular immunopharmaceuticals (SMIPs) from Trubion Pharmaceuticals. These molecules, which can be monovalent or bivalent, are recombinant single-chain molecules containing one $V_L$, one $V_H$ antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., *MAbs.* 2010. January-February; 2(1):77-83).

Diabodies

In some embodiments, payloads of the invention may encode diabodies. Diabodies are functional bispecific single-chain antibodies (bscAb). These bivalent antigen-binding molecules are composed of non-covalent dimers of scFvs, and can be produced in mammalian cells using recombinant methods. (See, e.g., Mack et al. *Proc. Natl. Acad. Sci.,* 92, 7021-7025, 1995). Few diabodies have entered clinical development. An iodine-123-labeled diabody version of the anti-CEA chimeric antibody cT84.66 has been evaluated for pre-surgical immunoscintigraphic detection of colorectal cancer in a study sponsored by the Beckman Research Institute of the City of Hope (Clinicaltrials.gov NCT00647153) (Nelson, A. L., *MAbs* 2010. January-February; 2(1):77-83)

Unibody

In some embodiments, payloads may encode a "unibody," in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light-heavy heterodimers, while retaining the Fc region to ensure stability and half-life in vivo. This configuration may minimize the risk of immune activation or oncogenic growth, as IgG4 interacts poorly with FcRs and monovalent unibodies fail to promote intracellular signaling complex formation. These contentions are, however, largely supported by laboratory, rather than clinical, evidence. Other antibodies may be "miniaturized" antibodies, which are compacted 100 kDa antibodies (see, e.g., Nelson, A. L., *MAbs.* 2010. January-February; 2(1):77-83).

Intrabodies

In some embodiments, payloads of the invention may encode intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

More than two decades ago, intracellular antibodies against intracellular targets were first described (Biocca, Neuberger and Cattaneo *EMBO J.* 9: 101-108, 1990). The intracellular expression of intrabodies in different compartments of mammalian cells allows blocking or modulation of the function of endogenous molecules (Biocca, et al., *EMBO J* 9: 101-108, 1990; Colby et al., Proc. Natl. Acad. Sci. U.S.A. 101: 17616-21, 2004) Intrabodies can alter protein folding, protein-protein, protein-DNA, protein-RNA interactions and protein modification. They can induce a phenotypic knockout and work as neutralizing agents by direct binding to the target antigen, by diverting its intracellular trafficking or by inhibiting its association with binding partners. They have been largely employed as research tools and are emerging as therapeutic molecules for the treatment of human diseases such as viral pathologies, cancer and misfolding diseases. The fast growing bio-market of recombinant antibodies provides intrabodies with enhanced binding specificity, stability and solubility, together with lower immunogenicity, for their use in therapy (Biocca, abstract in Antibody Expression and Production Cell Engineering Volume 7, 2011, pp. 179-195).

In some embodiments, intrabodies have advantages over interfering RNA (iRNA); for example, iRNA has been shown to exert multiple non-specific effects, whereas intrabodies have been shown to have high specificity and affinity to target antigens. Furthermore, as proteins, intrabodies possess a much longer active half-life than iRNA. Thus, when the active half-life of the intracellular target molecule is long, gene silencing through iRNA may be slow to yield an effect, whereas the effects of intrabody expression can be almost instantaneous. Lastly, it is possible to design intrabodies to block certain binding interactions of a particular target molecule, while sparing others.

Intrabodies are often single chain variable fragments (scFvs) expressed from a recombinant nucleic acid molecule and engineered to be retained intracellularly (e.g., retained in the cytoplasm, endoplasmic reticulum, or periplasm). Intrabodies may be used, for example, to ablate the function of a protein to which the intrabody binds. The expression of intrabodies may also be regulated through the use of inducible promoters in the nucleic acid expression vector comprising the intrabody. Intrabodies may be produced for use in the viral genomes of the invention using methods known in the art, such as those disclosed and reviewed in. (Marasco et al., 1993 *Proc. Natl. Acal. Sci. USA*, 90; 7889-7893; Chen et al., 1994, *Hum. Gene Ther.* 5:595-601; Chen et al., 1994, *Proc. Natl. Acad. Sci. USA*, 91: 5932-5936; Macieiewski et al, 1995, *Nature Med.*, 1: 667-673; Marasco, 1995, *Immunotech*, 1: 1-19; Mhashilkar, et al., 1995, *EMBO J.* 14: 1542-51; Chen et al., 1996, Hum. Gene Therap., 7: 1515-1525, Marasco, *Gene Ther.* 4:11-15, 1997, Rondon and Marasco, 1997, *Annu. Rev. Microbiol.* 51: 257-283; Cohen, et al., 1998, *Oncogene* 17:2445-56; Proba et al., 1998, *J. Mol. Biol.* 275:245-253; Cohen et al., 1998, *Oncogene* 17:2445-2456; Hassanzadeh, et al., 1998, *FEBS Lett.* 437: 81-6; Richardson et al., 1998, *Gene Ther* 5:635-44; Ohage and Steipe, 1999, *J. Mol. Biol* 291:1119-1128; Ohage et al., 1999, *J. Mol. Biol.* 291:1129-1134; Wirtz and Steipe, 1999, *Protein Sci.* 8:2245-2250; Zhu et al., 1999, *J. Immunol Methods* 231:207-222; Arafat et al., 2000, *Cancer Gene Ther.* 7:1250-6; der Maur et al., 2002, *J. Biol. Chem.* 277:45075-85, Mhashilkar et al., 2002, *Gene Ther.* 9:307-19; and Wheeler et al., 2003, *FASEB J.* 17: 1733-5, and references cited therein). In particular, a CCR5 intrabody has been produced by Steinberger et al., 2000), *Proc. Natl. Acad. Sci. USA* 97:805-810). See generally Marasco. W A. 1998, "Intrabodies: Basic Research and Clinical Gene Therapy Applications" Springer: New York, and for a review of scFvs, see Pluckthun in "The Pharmacology of Monoclonal Antibodies," 1994, vol. 113, Rosenburg and Moore eds. Springer-Verlag, New York, pp. 269-315.

Sequences from donor antibodies may be used to develop intrabodies. Intrabodies are often recombinantly expressed as single domain fragments such as isolated $V_H$ and $V_L$ domains or as a single chain variable fragment (scFv) antibody within the cell. For example, intrabodies are often expressed as a single polypeptide to form a single chain antibody comprising the variable domains of the heavy and light chains joined by a flexible linker polypeptide. Intrabodies typically lack disulfide bonds and are capable of modulating the expression or activity of target genes through their specific binding activity. Single chain antibodies can also be expressed as a single chain variable region fragment joined to the light chain constant region.

As is known in the art, an intrabody can be engineered into recombinant polynucleotide vectors to encode subcellular trafficking signals at its N or C terminus to allow expression at high concentrations in the sub-cellular compartments where a target protein is located. For example, intrabodies targeted to the endoplasmic reticulum (ER) are engineered to incorporate a leader peptide and, optionally, a C-terminal ER retention signal, such as the KDEL amino acid motif (SEQ ID NO: 9223). Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

There are certain technical challenges with intrabody expression. In particular, protein conformational folding and structural stability of the newly-synthesized intrabody within the cell is affected by reducing conditions of the intracellular environment.

Intrabodies of the invention may be promising therapeutic agents for the treatment of misfolding diseases, including Alzheimer's, Parkinson's, Huntington's and prion diseases, because of their virtually infinite ability to specifically recognize the different conformations of a protein, including pathological isoforms, and because they can be targeted to the potential sites of aggregation (both intra- and extracellular sites). These molecules can work as neutralizing agents against anmyloidogenic proteins by preventing their aggregation, and/or as molecular shunters of intracellular traffic by rerouting the protein from its potential aggregation site (Cardinale, and Biocca, *Curr Mol. Med* 2008, 8:2-11)

Maxibodies

In one embodiment, the payloads of the invention encode a maxibody (bivalent scFV fused to the amino terminus of the Fc (CH2-CH3 domains) of IgG, Chimeric Antigen Receptors In some embodiments, the polypeptides encoded by the viral genomes of the invention (e.g., antibodies) may be used to generate chimeric antigen receptors (CARs) as described by BIOATLA® in International Publications WO2016033331 and WO2016036916, the contents of which are herein incorporated by reference in their entirety. As used herein, a "chimeric antigen receptor (CAR)" refers to an artificial chimeric protein comprising at least one antigen specific targeting region (ASTR), wherein the antigen specific targeting region comprises a full-length antibody or a fragment thereof that specifically binds to a target antigen. The ASTR may comprise any of the following; a full length heavy or light chain, an Fab fragment, a single chain Fv fragment, a divalent single chain antibody, or a diabody. As a non-limiting example the ASTR of a CAR may be any of the antibodies listed in Tables 3-42, antibody-based compositions or fragments thereof. Any molecule that is capable of binding a target antigen with high affinity can be used in the ASTR of a CAR. In one embodiment, the CAR may have more than one ASTR. These ASTRs may target two or more antigens or two or more epitopes of the same antigen. In one embodiment, the CAR is conditionally active. In one embodiment, the CAR is used to produce a genetically engineered cytotoxic cell carrying the CAR and capable of targeting the antigen bound by the ASTR.

Chimeric antigen receptors (CARs) are particularly useful in the treatment of cancers, though also therapeutically effective in treatment of a wide variety of other diseases and disorders. Non-limiting examples of disease categories that may be treated with CARs or CAR-based therapeutics include autoimmune disorders, B-cell mediated diseases, inflammatory diseases, neuronal disorders, cardiovascular disease and circulatory disorders, or infectious diseases. Not wishing to be bound by theory, CARs traditionally work by targeting antigens presented on the surface of or on the inside of cells to be destroyed e.g., cancer tumor cells, by the cytotoxic cell of the CAR.

Senescent Cell Surface Protein Antibodies

In some embodiments, the AAV particles may comprise nucleic acids which have been engineered to express of antibodies that selectively bind to surface marker proteins of senescent cells. For example, the antibodies may selectively bind to proteins that are in misfolded conformation. The binding antibodies may reduce the number of senescent cells and be used to treat age-related conditions, such as, but not limited to, Alzheimer's disease, cardiovascular disease, emphysema, sarcopenia, and tumorigenesis as well as conditions more cosmetic in nature such as signs of skin aging including wrinkling, sagging, discoloration, age-related tissue dysfunction, tumor formation, and other age-related conditions.

In one embodiment, the expressed antibodies binding to epitopes of senescent cell surface proteins may be, but are not limited to, such as prion epitopes presented by SEQ ID NOs: 1-14 of International Publication No. WO2014186878, CD44 epitopes presented by SEQ ID NOs: 47-51 of International Publication No. WO2014186878; TNFR epitopes presented by SEQ ID NOs: 52-56 of International Publication No. WO2014186878; NOTCH1 epitope presented by SEQ ID NOs: 57-61 of International Publication No. WO2014186878; FasR epitopes presented by SEQ ID NOs: 62-66 of International Publication No. WO2014186878; epidermal growth factor epitopes presented by SEQ ID NOs: 67-81 of International Publication No. WO2014186878; CD38 epitopes presented by SEQ ID NOs: 82-86 of International Publication No. WO2014186878, the contents of each of which are herein incorporated by reference in their entirety.

In one embodiment, the expressed antibodies may comprise peptides binding to senescent cell surface prion proteins, such as, but not limited to, those presented by SEQ ID NOs: 15-36 of International Publication No. WO2014186878, the contents of which are herein incorporated by reference in their entirety.

In one embodiment, the expressed antibody may be AMF-3a-118 or AMF 3d-19 (SEQ ID NO: 89-92 and 103-106 of International publication WO2014186878, respectively, the contents of which are herein incorporated by reference in their entirety) targeting senescent cell surface protein FasR, In one embodiment, the expressed antibody may be Ab c-120 (SEQ ID NO: 37-40 of International publication WO2014186878, the contents of which are herein incorporated by reference in their entirety) targeting senescent cell surface protein PrP.

Payload Antibodies of the Invention

In one embodiment, the payload region of the AAV particle comprises one or more nucleic acid sequences encoding one or more of the payload antibody polypeptides listed in Tables 3-42.

In one embodiment, the payload region of the AAV particle comprises one or more nucleic acid sequences listed in Tables 3-42.

In some embodiments, the payload region of the AAV particle comprises a nucleic acid sequence encoding a payload antibody with at least 50% identity to one or more payload antibody polypeptides listed in Tables 3-42. The encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload antibody polypeptides listed in Tables 3-42.

In one embodiment, the full sequence of the encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload antibody polypeptides listed in Tables 3-42.

In one embodiment, the variable region sequence(s) of the encoded antibody polypeptide may have 50%, 51%, 52%, 53%, 54%, 55%, 56%, 57%, 58%, 59%, 60%, 61%, 62%, 63%, 064%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the pay load antibody polypeptides listed in Tables 3-42.

In one embodiment, the heavy chain of the encoded antibody polypeptide may have 50%, 51%, 52%, 53%, 54%, 55%, 56%, 57%, 58%, 59%, 60%, 61%, 62%, 63%, 64%, 65% 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload heavy chain antibody polypeptides listed in Tables 3-42.

In one embodiment, the light chain of the encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload light chain antibody polypeptides listed in Tables 3-42.

In one embodiment, the CDR region of the encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to the CDRs of one or more of the payload antibody polypeptides listed in Tables 3-42.

In one embodiment, the payload antibody has 90% identity to one or more of the antibody polypeptides listed in Tables 3-42.

In one embodiment, the payload antibody has 91% identity to one or more of the antibody polypeptides listed in Tables 3-42.

In one embodiment, the payload antibody has 92% identity to one or more of the antibody polypeptides listed in Tables 3-42.

In one embodiment, the payload antibody has 93% identity to one or more of the antibody polypeptides listed in Tables 3-42.

In one embodiment, the payload antibody has 94% identity to one or more of the antibody polypeptides listed in Tables 3-42.

In one embodiment, the payload antibody has 95% identity to one or more of the antibody polypeptides listed in Tables 3-42.

In one embodiment, the payload antibody has 96% identity to one or more of the antibody polypeptides listed in Tables 3-42.

In one embodiment, the payload antibody has 97% identity to one or more of the antibody polypeptides listed in Tables 3-42.

In one embodiment, the payload antibody has 98% identity to one or more of the antibody polypeptides listed in Tables 3-42.

In one embodiment, the payload antibody has 99% identity to one or more of the antibody polypeptides listed in Tables 3-42.

In one embodiment, the payload antibody has 100% identity to one or more of the antibody polypeptides listed in Tables 3-42.

In some embodiments, the payload region of the AAV particle comprises a nucleic acid sequence with at least 50% identity to one or more nucleic acid sequences listed in Tables 3-42. The payload nucleic acid sequence may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more nucleic acid sequences listed in Tables 3-42.

In one embodiment, the payload nucleic acid sequence has 90% identity to one or more of the nucleic acid sequences listed in Tables 3-42.

In one embodiment, the payload nucleic acid sequence has 91% identity to one or more of the nucleic acid sequences listed in Tables 3-42.

In one embodiment, the payload nucleic acid sequence has 92% identity to one or more of the nucleic acid sequences listed in Tables 3-42.

In one embodiment, the payload nucleic acid sequence has 93% identity to one or more of the nucleic acid sequences listed in Tables 3-42.

In one embodiment, the payload nucleic acid sequence has 94% identity to one or more of the nucleic acid sequences listed in Tables 3-42.

In one embodiment, the payload nucleic acid sequence has 95% identity to one or more of the nucleic acid sequences listed in Tables 3-42.

In one embodiment, the payload nucleic acid sequence has 96% identity to one or more of the nucleic acid sequences listed in Tables 3-42.

In one embodiment, the payload nucleic acid sequence has 97% identity to one or more of the nucleic acid sequences listed in Tables 3-42.

In one embodiment, the payload nucleic acid sequence has 98% identity to one or more of the nucleic acid sequences listed in Tables 3-42.

In one embodiment, the payload nucleic acid sequence has 99% identity to one or more of the nucleic acid sequences listed in Tables 3-42.

In one embodiment, the payload nucleic acid sequence has 100% identity to one or more of the nucleic acid sequences listed in Tables 3-42.

In one embodiment, the payload region of the AAV particle comprises a nucleic acid sequence encoding a polypeptide which is an antibody, an antibody-based composition, or a fragment thereof. As a non-limiting example, the antibody may be one or more of the polypeptides listed in Tables 3-42. As another non-limiting example, the antibody may be one or more of the heavy chain sequences listed in Tables 3-42. As a non-limiting example, the antibody may be one or more of the light chain sequences listed in Tables 3-42.

In one embodiment, the payload region of the AAV particle comprises a nucleic acid sequence encoding a polypeptide comprising a heavy chain and a light chain sequence listed in Tables 3-42. The payload region may also comprise a linker between the heavy and light chain sequences. The linker may be a sequence known in the art or described in Table 2.

In one embodiment, the payload region of the AAV particle comprises a nucleic acid sequence encoding a polypeptide comprising a heavy chain and a light chain sequence listed in Tables 3-42, where the heavy chain sequence is from a different antibody than the light chain sequence. The payload region may also comprise a linker between the heavy and light chain sequences. The linker may be a sequence known in the art or described in Table 2.

In one embodiment, the payload region comprises, in the 5' to 3' direction, an antibody light chain sequence, a linker and a heavy chain sequence.

In one embodiment, the payload region comprises a nucleic acid sequence encoding, in the 5' to 3' direction, an antibody light chain sequence from Tables 3-42, a linker from Table 2 and a heavy chain sequence from Tables 3-42.

In one embodiment, the payload region comprises, in the 5' to 3' direction, an antibody heavy chain sequence, a linker and a light chain sequence.

In one embodiment, the payload region comprises a nucleic acid sequence encoding, in the 5' to 3' direction, an antibody heavy chain sequence from Tables 3-42, a linker from Table 2 and a light chain sequence from Tables 3-42.

In one embodiment, the payload region comprises a nucleic acid sequence encoding a single heavy chain. As a non-limiting example, the heavy chain is an amino acid sequence or fragment thereof described in Tables 3-42.

Shown in Tables 3-42 are a listing of antibodies and their polynucleotides and/or polypeptides sequences. These sequences may be encoded by or included in the AAV particles of the present invention. Variants or fragments of the antibody sequences described in Tables 3-42 may be utilized in the AAV particles of the present invention.

In some embodiments, the AAV particles may comprise codon-optimized versions of the nucleic acids encoding the polypeptides listed in Tables 3-42. In some cases, the payload region of the AAV particles of the invention may encode one or more isoforms or variants of these heavy and light chain antibody domains. Such variants may be humanized or optimized antibody domains comprising one or more complementarity determining regions (CDRs) from the heavy and light chains listed in Tables 3-42. Methods of determining CDRs are well known in the art and are described herein Payload regions may encode antibody variants with one or more heavy chain variable domain ($V_H$) or light chain variable domain ($V_L$) derived from the antibody sequences in Tables 3-42. In some cases, such variants may include bispecific antibodies. Bispecific antibodies encoded by payload regions of the invention may comprise variable domain pairs from two different antibodies.

In one embodiment, the AAV particles may comprise a heavy and a light chain of an antibody described herein and two promoters. As a non-limiting example, the AAV particles may comprise a nucleic acid sequence of a genome as described in FIG. 1 or FIG. 2 of US Patent Publication No. US20030219733, the contents of which are herein incorporated by reference in its entirety. As another non-limiting example, the AAV particles may be a dual-promoter AAV for antibody expression as described by Lewis et al. (J. of Virology, September 2002, Vol. 76(17), p 8769-8775; the contents of which are herein incorporated by reference in its entirety).

Foodborne Illness and Gastroenteritis Related Antibodies

In one embodiment, the payload region of the AAV particle comprises one or more nucleic acid sequences encoding one or more of the gastrointestinal and food illness related payload antibody polypeptides listed in Tables 3-9.

In one embodiment, the payload region of the AAV particle comprises one or more nucleic acid sequences encoding one or more of the payload antibody polypeptides listed in Table 3 against *Clostridium difficile* toxins

TABLE 3

Antibodies against *Clostridium Difficile* toxins

| Antibody No. | Description | Antibody Name | Reference Information | SEQ ID NO |
|---|---|---|---|---|
| CD1 | Camelid heavy chain only, Toxin A and B, | | WO2015100409 SEQ ID NO: 164 | 2948 |
| CD2 | Camelid heavy chain only, Toxin A and B, | | WO2015100409 SEQ ID NO: 165 | 2949 |
| CD3 | Camelid heavy chain only, Toxin A and B, | | WO2015100409 SEQ ID NO: 166 | 2950 |
| CD4 | Camelid heavy chain only, Toxin A and B, | | WO2015100409 SEQ ID NO: 167 | 2951 |
| CD5 | Heavy chain variable region, toxin A | PA-39 | U.S. Pat. No. 8,986,697 SEQ ID NO: 1 | 2952 |
| CD6 | Heavy chain variable region, toxin A | PA-39 | U.S. Pat. No. 8,986,697 SEQ ID NO: 2 | 2953 |
| CD7 | Heavy chain variable region, toxin A | PA-50 | U.S. Pat. No. 8,986,697 SEQ ID NO: 5 | 2954 |
| CD8 | Heavy chain variable region, toxin A | PA-50 | U.S. Pat. No. 8,986,697 SEQ ID NO: 6 | 2955 |
| CD9 | Heavy chain variable region, toxin A | | US20130202618 SEQ ID NO: 1 | 2956 |
| CD10 | Heavy chain variable region, toxin A | | US20130202618 SEQ ID NO: 2 | 2957 |
| CD11 | Heavy chain variable region, toxin A | | US20130202618 SEQ ID NO: 5 | 2958 |
| CD12 | Heavy chain variable region, toxin A | | US20130202618 SEQ ID NO: 6 | 2959 |
| CD13 | Heavy chain variable region, toxin A and/or toxin B | H1H3067N | US20130230531 SEQ ID NO: 34 | 2960 |
| CD14 | Heavy chain variable region, toxin A and/or toxin B | H1H3134N | US20130230531 SEQ ID NO: 18 | 2961 |
| CD15 | Heavy chain variable region, toxin A and/or toxin B | H1H3117N | US20130230531 SEQ ID NO: 2 | 2962 |
| CD16 | Heavy chain variable region, toxin A and/or toxin B | H1H3123N | US20130230531 SEQ ID NO: 66 | 2963 |
| CD17 | Heavy chain variable region, toxin A and/or toxin B | H1H3121N | US20130230531 SEQ ID NO: 50 | 2964 |
| CD18 | Heavy chain variable region, toxin A and/or toxin B | H1H3124N | US20130230531 SEQ ID NO: 82 | 2965 |
| CD19 | Heavy chain variable region, toxin A and/or toxin B | H1H3328P | US20130230531 SEQ ID NO: 130 | 2966 |
| CD20 | Heavy chain variable region, toxin A and/or toxin B | H1H3324P | US20130230531 SEQ ID NO: 98 | 2967 |
| CD21 | Heavy chain variable region, toxin A and/or toxin B | H1H3325P | US20130230531 SEQ ID NO: 114 | 2968 |
| CD22 | Heavy chain variable region, toxin A and/or toxin B | H1H3330P | US20130230531 SEQ ID NO: 146 | 2969 |
| CD23 | Heavy chain variable region, toxin A and/or toxin B | H1H3350P | US20130230531 SEQ ID NO: 162 | 2970 |

TABLE 3-continued Antibodies against *Clostridium Difficile* toxins

| Antibody No. | Description | Antibody Name | Reference Information | SEQ ID NO |
|---|---|---|---|---|
| CD24 | Heavy chain variable region, toxin A and/or toxin B | H1H3347P | US20130230531 SEQ ID NO: 274 | 2971 |
| CD25 | Heavy chain variable region, toxin A and/or toxin B | H1H3335P | US20130230531 SEQ ID NO: 194 | 2972 |
| CD26 | Heavy chain variable region, toxin A and/or toxin B | H1H3344P | US20130230531 SEQ ID NO: 258 | 2973 |
| CD27 | Heavy chain variable region, toxin A and/or toxin B | H1H3339P | US20130230531 SEQ ID NO: 226 | 2974 |
| CD28 | Heavy chain variable region, toxin A and/or toxin B | H1H3337P | US20130230531 SEQ ID NO: 210 | 2975 |
| CD29 | Heavy chain variable region, toxin A and/or toxin B | H1H3343P | US20130230531 SEQ ID NO: 242 | 2976 |
| CD30 | Heavy chain variable region, toxin A and/or toxin B | H1H3411P | US20130230531 SEQ ID NO: 354 | 2977 |
| CD31 | Heavy chain variable region, toxin A and/or toxin B | H1H3354P | US20130230531 SEQ ID NO: 290 | 2978 |
| CD32 | Heavy chain variable region, toxin A and/or toxin B | H1H3317P | US20130230531 SEQ ID NO: 178 | 2979 |
| CD33 | Heavy chain variable region, toxin A and/or toxin B | H1H3355P | US20130230531 SEQ ID NO: 306 | 2980 |
| CD34 | Heavy chain variable region, toxin A and/or toxin B | H1H3394P | US20130230531 SEQ ID NO. 322 | 2981 |
| CD35 | Heavy chain variable region, toxin A and/or toxin B | H1H3401P | US20130230531 SEQ ID NO: 338 | 2982 |
| CD36 | Heavy chain variable region, toxin B | PA-41 | U.S. Pat. No. 8,986,697 SEQ ID NO: 8 | 2983 |
| CD37 | Heavy chain variable region, toxin B | PA-41 | U.S. Pat. No. 8,986,697 SEQ ID NO: 9 | 2984 |
| CD38 | Heavy chain variable region, toxin B | | US20130202618 SEQ ID NO: 8 | 2985 |
| CD39 | Heavy chain variable region, toxin B | | US20130202618 SEQ ID NO: 9 | 2986 |
| CD40 | Heavy chain, toxin A | 3D8 | U.S. Pat. No. 8,609,111 SEQ ID NO: 1 | 2987 |
| CD41 | Heavy chain, toxin A | 1B11 | U.S. Pat. No. 8,609,111 SEQ ID NO: 2 | 2988 |
| CD42 | Heavy chain, toxin A | 33.3H2 | U.S. Pat. No. 8,609,111 SEQ ID NO: 3 | 2989 |
| CD43 | Heavy chain, toxin A | | US20140004118 SEQ ID NO: 89 | 2990 |
| CD44 | Heavy chain, toxin A | | US20140004118 SEQ ID NO: 93 | 2991 |
| CD45 | Heavy chain, toxin B | | US20130058962 SEQ ID NO: 65 | 2992 |
| CD46 | Heavy chain, toxin B | Bezlotoxumab | | 2993 |
| CD47 | Heavy-chain-only, toxin A | | US20130058962 SEQ ID NO: 59 | 2994 |
| CD48 | Heavy-chain-only, toxin A | | US20130058962 SEQ ID NO: 60 | 2995 |
| CD49 | Heavy-chain-only, toxin A | | US20130058962 SEQ ID NO: 61 | 2996 |
| CD50 | Heavy-chain-only, toxin A | | US20130058962 SEQ ID NO: 62 | 2997 |
| CD51 | Heavy-chain-only, toxin A | | US20130058962 SEQ ID NO: 63 | 2998 |
| CD52 | Heavy-chain-only, toxin A | | US20130058962 SEQ ID NO: 64 | 2999 |
| CD53 | Heavy-chain-only, toxin A | | US20130058962 SEQ ID NO: 87 | 3000 |
| CD54 | Heavy-chain-only, toxin A | | US20130058962 SEQ ID NO: 95 | 3001 |
| CD55 | Heavy-chain-only, toxin B | 124-152 | U.S. Pat. No. 8,609,111 SEQ ID NO: 54 | 3002 |
| CD56 | Heavy-chain-only, toxin B | | US20130058962 SEQ ID NO: 66 | 3003 |
| CD57 | Heavy-chain-only, toxin B | | US20130058962 SEQ ID NO: 67 | 3004 |

TABLE 3-continued

Antibodies against *Clostridium Difficile* toxins

| Antibody No. | Description | Antibody Name | Reference Information | SEQ ID NO |
|---|---|---|---|---|
| CD58 | Heavy-chain-only, toxin B | | US20130058962 SEQ ID NO: 68 | 3005 |
| CD59 | Heavy-chain-only, toxin B | | US20130058962 SEQ ID NO: 69 | 3006 |
| CD60 | Heavy-chain-only, toxin B | | US20130058962 SEQ ID NO: 70 | 3007 |
| CD61 | Heavy-chain-only, toxin B | | US20130058962 SEQ ID NO: 71 | 3008 |
| CD62 | Heavy-chain-only, toxin B | | US20130058962 SEQ ID NO: 72 | 3009 |
| CD63 | Heavy-chain-only, toxin B | | US20130058962 SEQ ID NO: 73 | 3010 |
| CD64 | Heavy-chain-only, toxin B | | US20130058962 SEQ ID NO: 74 | 3011 |
| CD65 | Heavy-chain-only, toxin B | | US20130058962 SEQ ID NO: 75 | 3012 |
| CD66 | Heavy-chain-only, toxin B | | US20130058962 SEQ ID NO: 76; SEQ ID NO: 87; SEQ ID NO: 95 | 3013 |
| CD67 | Light chain variable region, toxin A | PA-39 | U.S. Pat. No. 8,986,697 SEQ ID NO: 3 | 3014 |
| CD68 | Light chain variable region, toxin A | PA-39 | U.S. Pat. No. 8,986,697 SEQ ID NO: 4 | 3015 |
| CD69 | Light chain variable region, toxin A | PA-50 | U.S. Pat. No. 8,986,697 SEQ ID NO: 7 | 3016 |
| CD70 | Light chain variable region, toxin A | | US20130202618 SEQ ID NO: 3 | 3017 |
| CD71 | Light chain variable region, toxin A | | US20130202618 SEQ ID NO: 4 | 3018 |
| CD72 | Light chain variable region, toxin A | | US20130202618 SEQ ID NO: 7 | 3019 |
| CD73 | Light chain variable region, toxin A and/or toxin B | H1H3067N | US20130230531 SEQ ID NO: 42 | 3020 |
| CD74 | Light chain variable region, toxin A and/or toxin B | H1H3134N | US20130230531 SEQ ID NO: 26 | 3021 |
| CD75 | Light chain variable region, toxin A and/or toxin B | H1H3117N | US20130230531 SEQ ID NO: 10 | 3022 |
| CD76 | Light chain variable region, toxin A and/or toxin B | H1H3123N | US20130230531 SEQ ID NO: 74 | 3023 |
| CD77 | Light chain variable region, toxin A and/or toxin B | H1H3121N | US20130230531 SEQ ID NO: 58 | 3024 |
| CD78 | Light chain variable region, toxin A and/or toxin B | H1H3124N | US20130230531 SEQ ID NO: 90 | 3025 |
| CD79 | Light chain variable region, toxin A and/or toxin B | H1H3328P | US20130230531 SEQ ID NO: 138 | 3026 |
| CD80 | Light chain variable region, toxin A and/or toxin B | H1H3324P | US20130230531 SEQ ID NO: 106 | 3027 |
| CD81 | Light chain variable region, toxin A and/or toxin B | H1H3325P | US20130230531 SEQ ID NO: 122 | 3028 |
| CD82 | Light chain variable region, toxin A and/or toxin B | H1H3330P | US20130230531 SEQ ID NO: 154 | 3029 |
| CD83 | Light chain variable region, toxin A and/or toxin B | H1H3350P | US20130230531 SEQ ID NO: 170 | 3030 |
| CD84 | Light chain variable region, toxin A and/or toxin B | H1H3347P | US20130230531 SEQ ID NO: 282 | 3031 |
| CD85 | Light chain variable region, toxin A and/or toxin B | H1H3335P | US20130230531 SEQ ID NO: 202 | 3032 |
| CD86 | Light chain variable region, toxin A and/or toxin B | H1H3344P | US20130230531 SEQ ID NO: 266 | 3033 |
| CD87 | Light chain variable region, toxin A and/or toxin B | H1H3339P | US20130230531 SEQ ID NO: 234 | 3034 |
| CD88 | Light chain variable region, toxin A and/or toxin B | H1H3337P | US20130230531 SEQ ID NO: 218 | 3035 |
| CD89 | Light chain variable region, toxin A and/or toxin B | H1H3343P | US20130230531 SEQ ID NO: 250 | 3036 |
| CD90 | Light chain variable region, toxin A and/or toxin B | H1H3411P | US20130230531 SEQ ID NO: 362 | 3037 |
| CD91 | Light chain variable region, toxin A and/or toxin B | H1H3354P | US20130230531 SEQ ID NO: 298 | 3038 |

TABLE 3-continued

Antibodies against *Clostridium Difficile* toxins

| Antibody No. | Description | Antibody Name | Reference Information | SEQ ID NO |
|---|---|---|---|---|
| CD92 | Light chain variable region, toxin A and/or toxin B | H1H3317P | US20130230531 SEQ ID NO: 186 | 3039 |
| CD93 | Light chain variable region, toxin A and/or toxin B | H1H3355P | US20130230531 SEQ ID NO: 314 | 3040 |
| CD94 | Light chain variable region, toxin A and/or toxin B | H1H3394P | US20130230531 SEQ ID NO: 330 | 3041 |
| CD95 | Light chain variable region, toxin A and/or toxin B | H1H3401P | US20130230531 SEQ ID NO: 346 | 3042 |
| CD96 | Light chain variable region, toxin B | PA-41 | U.S. Pat. No. 8,986,697 SEQ ID NO: 10 | 3043 |
| CD97 | Light chain variable region, toxin B | | US20130202618 SEQ ID NO: 10 | 3044 |
| CD98 | Light chain, toxin A | 3D8 | U.S. Pat. No. 8,609,111 SEQ ID NO: 4 | 3045 |
| CD99 | Light chain, toxin A | 1B11 | U.S. Pat. No. 8,609,111 SEQ ID NO: 5 | 3046 |
| CD100 | Light chain, toxin A | 33.3H2 | U.S. Pat. No. 8,609,111 SEQ ID NO: 6 | 3047 |
| CD101 | Light chain, toxin A | | US20140004118 SEQ ID NO: 91 | 3048 |
| CD102 | Light chain, toxin A | | US20140004118 SEQ ID NO: 95 | 3049 |
| CD103 | Light chain, toxin B | 124-152 | U.S. Pat. No. 8,609,111 SEQ ID NO: 58 | 3050 |
| CD104 | Light chain, toxin B | Bezlotoxumab | | 3051 |
| CD105 | Recombinant camelid heavy chain only, Toxin A and B | | WO2015100409 SEQ ID NO: 87 | 3052 |
| CD106 | Recombinant camelid heavy chain only, Toxin A and B | | WO2015100409 SEQ ID NO: 95 | 3053 |
| CD107 | Recombinant camelid heavy-chain-only, toxin A | | WO2015100409 SEQ ID NO: 59 | 3054 |
| CD108 | Recombinant camelid heavy-chain-only, toxin A | | WO2015100409 SEQ ID NO: 60 | 3055 |
| CD109 | Recombinant camelid heavy-chain-only, toxin A | | WO2015100409 SEQ ID NO: 61 | 3056 |
| CD110 | Recombinant camelid heavy-chain-only, toxin A | | WO2015100409 SEQ ID NO: 62 | 3057 |
| CD111 | Recombinant camelid heavy-chain-only, toxin A | | WO2015100409 SEQ ID NO: 63 | 3058 |
| CD112 | Recombinant camelid heavy-chain-only, toxin A | | WO2015100409 SEQ ID NO: 64 | 3059 |
| CD113 | Recombinant camelid heavy-chain-only, toxin B | | WO2015100409 SEQ ID NO: 65 | 3060 |
| CD114 | Recombinant camelid heavy-chain-only, toxin B | | WO2015100409 SEQ ID NO: 66 | 3061 |
| CD115 | Recombinant camelid heavy-chain-only, toxin B | | WO2015100409 SEQ ID NO: 67 | 3062 |
| CD116 | Recombinant camelid heavy-chain-only, toxin B | | WO2015100409 SEQ ID NO: 68 | 3063 |
| CD117 | Recombinant camelid heavy-chain-only, toxin B | | WO2015100409 SEQ ID NO: 69 | 3064 |
| CD118 | Recombinant camelid heavy-chain-only, toxin B | | WO2015100409 SEQ ID NO: 70 | 3065 |
| CD119 | Recombinant camelid heavy-chain-only, toxin B | | WO2015100409 SEQ ID NO: 71 | 3066 |
| CD120 | Recombinant camelid heavy-chain-only, toxin B | | WO2015100409 SEQ ID NO: 72 | 3067 |
| CD121 | Recombinant camelid heavy-chain-only, toxin B | | WO2015100409 SEQ ID NO: 73 | 3068 |
| CD122 | Recombinant camelid heavy-chain-only, toxin B | | WO2015100409 SEQ ID NO: 74 | 3069 |
| CD123 | Recombinant camelid heavy-chain-only, toxin B | | WO2015100409 SEQ ID NO: 75 | 3070 |
| CD124 | Recombinant camelid heavy-chain-only, toxin B | | WO2015100409 SEQ ID NO: 76 | 3071 |
| CD125 | Toxin A | Actoxumab | | 3072 |
| CD126 | Toxin A | Actoxumab | | 3073 |

TABLE 3-continued

Antibodies against *Clostridium Difficile* toxins

| Antibody No. | Description | Antibody Name | Reference Information | SEQ ID NO |
|---|---|---|---|---|
| CD127 | Toxin A | MK3415A (Actoxumab + bezlotoxumab) | U.S. Pat. No. 7,625,559 SEQ ID NO: 1 | 3074 |
| CD128 | Toxin A | MK3415A (Actoxumab + bezlotoxumab) | U.S. Pat. No. 7,625,559 SEQ ID NO: 4 | 3075 |
| CD129 | Toxin A | MK3415A (Actoxumab + bezlotoxumab) | U.S. Pat. No. 7,625,559 SEQ ID NO: 54 | 3076 |
| CD130 | Toxin A | MK3415A (Actoxumab + bezlotoxumab) | U.S. Pat. No. 7,625,559 SEQ ID NO: 58 | 3077 |
| CD131 | Toxin A | A4.2 | US20130230537 SEQ ID NO: 34 | 3078 |
| CD132 | Toxin A | A5.1 | US20130230537 SEQ ID NO: 35 | 3079 |
| CD133 | Toxin A | A19.2 | US20130230537 SEQ ID NO: 36 | 3080 |
| CD134 | Toxin A | A20.1 | US20130230537 SEQ ID NO: 37 | 3081 |
| CD135 | Toxin A | A24.1 | US20130230537 SEQ ID NO: 38 | 3082 |
| CD136 | Toxin A | A26.8 | US20130230537 SEQ ID NO: 39 | 3083 |
| CD137 | Toxin B | B5.2 | US20130230537 SEQ ID NO: 40 | 3084 |
| CD138 | Toxin B | B7.3 | US20130230537 SEQ ID NO: 41 | 3085 |
| CD139 | Toxin B | B13.6 | US20130230537 SEQ ID NO: 42 | 3086 |
| CD140 | Toxin B | B15.3 | US20130230537 SEQ ID NO: 43 | 3087 |
| CD141 | Toxin B | B15.5 | US20130230537 SEQ ID NO: 44 | 3088 |

In one embodiment, the payload region of the AAV particle comprises one or more nucleic acid sequences encoding one or more of the payload antibody polypeptides listed in Table 4 against *Campylobacter jejuni*

TABLE 4

Antibodies against *Campylobacter jejuni*

| Antibody No. | Description | Antibody Name | Reference Information | SEQ ID NO |
|---|---|---|---|---|
| CAMP1 | Consensus | FlagV1 | WO2014063253 SEQ ID NO: 7 | 3089 |
| CAMP2 | — | FlagV1M | WO2014063253 SEQ ID NO: 8 | 3090 |
| CAMP3 | — | FlagV1F23M | WO2014063253 SEQ ID NO: 9 | 3091 |
| CAMP4 | — | FlagV1MDSB | WO2014063253 SEQ ID NO: 10 | 3092 |
| CAMP5 | — | FlagV1MDSB | WO2014063253 SEQ ID NO: 11 | 3093 |
| CAMP6 | Consensus | FlagV6 | WO2014063253 SEQ ID NO: 12 | 3094 |
| CAMP7 | — | FlagV6M | WO2014063253 SEQ ID NO: 13 | 3095 |
| CAMP8 | — | FlagV6F23M | WO2014063253 SEQ ID NO: 14 | 3096 |
| CAMP9 | — | FlagV6MDSB | WO2014063253 SEQ ID NO: 15 | 3097 |
| CAMP10 | — | FlagV6F23MDSB | WO2014063253 SEQ ID NO: 16 | 3098 |

In one embodiment, the payload region of the AAV particle comprises one or more nucleic acid sequences encoding one or more of the payload antibody polypeptides listed in Table 5 against bacterial infections of the intestine.

TABLE 5

Antibodies against bacterial infections of the intestine

| Antibody No. | Description | Antibody Name | Reference Information | SEQ ID NO |
|---|---|---|---|---|
| BACG1 | Antibody against *Listeria* monocytogenes | Antibody from CN103497252 | CN103497252 SEQ ID NO: 1 | 3099 |

TABLE 5-continued

Antibodies against bacterial infections of the intestine

| Antibody No. | Description | Antibody Name | Reference Information | SEQ ID NO |
|---|---|---|---|---|
| BACG2 | Bivalent monovalent antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | anti-LYS3-long hinge/Cys-Tag | U.S. Pat. No. 7,655,759 SEQ ID NO: 22 | 3100 |
| BACG3 | Heavy chain only, Antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | LYS2 VHH | U.S. Pat. No. 7,655,759 SEQ ID NO: 18 | 3101 |
| BACG4 | Heavy chain only, Antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | LYS3 VHH | U.S. Pat. No. 7,655,759 SEQ ID NO: 24 | 3102 |
| BACG5 | Heavy chain segment including variable region, *Starhylococcus* enterotoxin B | F10 | U.S. Pat. No. 8,895,704 SEQ ID NO: 30 | 3103 |
| BACG6 | Heavy chain variable region. Antibody against, *P. aeruginosa*, *Proteus Vulgaris*, non-pathogenic *E. coli*, *Citrobacter freundii*, *Serratia marcenscens*, *Enterobacter cloacae*, *Campylobacter jejuni*, *Helicobacter pylori*, *Salmonella typhimurium*, *Salmonella muenchen*, *Proteus mirabilis* and Enteropathogenic *E. coli*, | mAb 741 | U.S. Pat. No. 8,263,078 SEQ ID NO: 1 | 3104 |
| BACG7 | Heavy chain variable region, Antibody against, *P. aeruginosa*, *Proteus Vulgaris*, non-pathogenic *E. Coli*, *Citrobacter freundii*, *Serratia marcenscens*, *Enterobacter cloacae*, *Campylobacter jejuni*, *Helicobacter pylori*, *Salmonella typhimurium*, *Salmonella* muenchen, *Proteus mirabilis* and Enteropathogenic *E. coli*., | mAb 763 | U.S. Pat. No. 8,263,078 SEQ ID NO: 2 | 3105 |
| BACG8 | Heavy chain variable region, antibody against flagellin from *Salmonella* or *Pseudomonas* | | U.S. Pat. No. 8,173,130 SEQ ID NO: 1 | 3106 |
| BACG9 | Heavy chain variable region, Antibody against Gram negative (*E. coli*, *Salmonella*, *Serratia*, *Proteus*, *Enterobacter*, *Citrobacter*, *Campylobacter* and *Pseudomonas*) | INO 743 | US20100239583 SEQ ID NO: 1 | 3107 |
| BACG10 | Heavy chain variable region, Antibody against *Helicobacter pyroli* | Abba3 | U.S. Pat. No. 8,025,880 SEQ ID NO: 18 | 3108 |
| BACG11 | Heavy chain variable region, Antibody against *Helicobacter pyroli* | IgHV3-48*3 | U.S. Pat. No. 8,025,880 SEQ ID NO: 20 | 3109 |
| BACG12 | Heavy chain variable region, Antibody against *Helicobacter pyroli* | clone 5 | U.S. Pat. No. 8,025,880 SEQ. ID NO: 21 | 3110 |
| BACG13 | Heavy chain variable region, Antibody against *Helicobacter pyroli* | C4 | U.S. Pat. No. 8,025,880 SEQ ID NO: 22 | 3111 |
| BACG14 | Heavy chain variable region, Antibody against *Helicobacter pyroli* | IgHV1-18*01 | U.S. Pat. No. 8,025,880 SEQ ID NO: 23 | 3112 |
| BACG15 | Heavy chain variable region, Antibody against *Helicobacter pyroli* | C5 | U.S. Pat. No. 8,025,880 SEQ ID NO: 24 | 3113 |
| BACG16 | Heavy chain variable region, antibody against many pathogens, | SWLA3 | WO2003007989 SEQ ID NO: 4 | 3114 |
| BACG17 | Heavy chain variable region, antibody against *Streptococcus mutans*, *Escherichia coli*, *Shigella dysenteriae*, *Salmonella typhimurium*, *Streptococcus pneumoniae*, *Staphylococcus aureus*, and *Pseudomonas aeruginosa* | SWLA3 | US20040052814 SEQ ID NO: 4 | 3115 |
| BACG18 | Heavy chain variable region, antibody against *Streptococcus* mutans, *Escherichia coli*, *Shigella dysenteriae*, *Salmonella typhimurium*, *Streptococcus pneumoniae*, *Staphylococcus aureus*, and *Pseudomonas aeruginosa* | SWLA3 | US20040052814 SEQ ID NO: 8 | 3116 |

TABLE 5-continued

Antibodies against bacterial infections of the intestine

| Antibody No. | Description | Antibody Name | Reference Information | SEQ ID NO |
|---|---|---|---|---|
| BACG19 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab1 | WO2012162253 SEQ ID NO: 4 | 3117 |
| BACG20 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab2 | WO2012162253 SEQ. ID NO: 14 | 3118 |
| BACG21 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab3 | WO2012162253 SEQ ID NO: 24 | 3119 |
| BACG22 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab4 | WO2012162253 SEQ ID NO: 34 | 3120 |
| BACG23 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab5 | WO2012162253 SEQ ID NO: 44 | 3121 |
| BACG24 | Heavy chain, antibody against *E coli*, *Shigella*, Entaamoeba histolytica, *Salmonella*, *Campylobacter*, or *Clostridium difficile*, iotavirus, RSV, HIV, nomoyirus, adenovirus, and astrovirus, other diseases causing diarrhea, | Ab6 | WO2012162253 SEQ ID NO: 54 | 3122 |
| BACG25 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab7 | WO2012162253 SEQ ID NO: 64 | 3123 |
| BACG26 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab8 | WO2012162253 SEQ ID NO: 74 | 3124 |
| BACG27 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab9 | WO2012162253 SEQ ID NO: 84 | 3125 |
| BACG28 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab10 | WO2012162253 SEQ ID NO: 94 | 3126 |
| BACG29 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab11 | WO2012162253 SEQ ID NO: 104 | 3127 |
| BACG30 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab12 | WO2012162253 SEQ ID NO: 114 | 3128 |
| BACG31 | Heavy chain, antibody against *E coli*, *Shigella*, Entaamoeba histolytica, *Salmonella*. *Campylobacter*, or *Clostridium difficile*, iotavirus, RSV, HIV, nomoyirus, adenovirus, and astrovirus, other diseases causing diarrhea, | Ab13 | WO2012162253 SEQ ID NO: 124 | 3129 |
| BACG32 | Heavy chain, antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea, | Ab14 | WO2012162253 SEQ ID NO: 134 | 3130 |
| BACG33 | Heavy chain, Antibody against *Escherichia coli* infection, *Staphylococcus* infection | | WO2014070117 SEQ ID NO: 3 | 3131 |

TABLE 5-continued

Antibodies against bacterial infections of the intestine

| Antibody No. | Description | Antibody Name | Reference Information | SEQ ID NO |
|---|---|---|---|---|
| BACG34 | Heavy chain, Antibody against *Listeria* monocytogenes or WR-tubercle bacillus | 6H8 | U.S. Pat. No. 8,445,643 SEQ ID NO: 5 | 3132 |
| BACG35 | Heavy chain, Antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | | U.S. Pat. No. 7,655,759 SEQ ID NO: 25 | 3133 |
| BACG36 | Heavy chain, Antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | | U.S. Pat. No. 7,655,759 SEQ ID NO: 26 | 3134 |
| BACG37 | Heavy chain, *Starhylococcus* enterotoxin B | 100C9 | U.S. Pat. No. 8,895,704 SEQ ID NO: 34 | 3135 |
| BACG38 | Heavy chain, *Starhylococcus* enterotoxin B | 79G9+ | U.S. Pat. No. 8,895,704 SEQ ID NO: 38 | 3136 |
| BACG39 | Heavy chain, *Starhylococcus* enterotoxin B | 79G9 | U.S. Pat. No. 8,895,704 SEQ ID NO: 126 | 3137 |
| BACG40 | Heavy chain, *Starhylococcus* enterotoxin B | 154G12 | U.S. Pat. No. 8,895,704 SEQ ID NO: 142 | 3138 |
| BACG41 | Light chain variable region, Antibody against, *P. aeruginosa*, *Proteus Vulgaris*, non-pathogenic *E. coli*, *Citrobacter freundii*, *Serratia marcenscens*, *Enterobacter cloacae*, *Campylobacter jejuni*, *Helicobacter pylori*, *Salmonella typhimurium*, *Salmonella* muenchen, *Proteus mirabilis* and Enteropathogenic *E. coli* | mAb 741 | U.S. Pat. No. 8,263,078 SEQ ID NO: 3 | 3139 |
| BACG42 | Light chain variable region, Antibody against, *P. aeruginosa*, *Proteus Vulgaris*, non-pathogenic *E. coli*, *Citrobacter freundii*, *Serratia marcenscens*, *Enterobacter cloacae*, *Campylobacter jejuni*, *Helicobacter pylori*, *Salmonella typhimurium*, *Salmonella* muenchen, *Proteus mirabilis* and Enteropathogenic *E. coli* | mAb 763 | U.S. Pat. No. 8,263,078 SEQ ID NO: 4 | 3140 |
| BACG43 | Light chain variable region, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab1 | WO2012162253 SEQ ID NO: 1 | 3141 |
| BACG44 | Light chain variable region, antibody against flagellin from *Salmonella* or *Pseudomonas* | | U.S. Pat. No. 8,173,130 SEQ ID NO: 3 | 3142 |
| BACG45 | Light chain variable region, Antibody against Gram negative (*E. coli*, *Salmonella*, *Serratia*, *Proteus*, *Enterobacter*, *Citrobacter*, *Campylobacter* and *Pseudomonas*) | INO 743 | US20100239583 SEQ ID NO: 2 | 3143 |
| BACG46 | Light chain variable region, Antibody against *Helicobacter pyroli* | Abba3 | U.S. Pat. No. 8,025,880 SEQ ID NO: 19 | 3144 |
| BACG47 | Light chain variable region, Antibody against many pathogens | SWLA3 | WO2003007989 SEQ ID NO: 7 | 3145 |
| BACG48 | Light chain, Antibody against *E. coli*, *Shigaella*, Entaamoeba histolvtica, *Salmonella*, *Campylobacter*, or *Clostridium difficile* or a virus selected from rotavirus, RSV, HIV, norvovirus, adenovirus, and astrovirus | Ab 1 | US201200294822 SEQ ID NO: 2 | 3146 |
| BACG49 | Light chain, Antibody against *E. coli*, *Shigaella*, Entaamoeba histolvtica, *Salmonella*, *Campylobacter*, or *Clostridium difficile* or a virus selected from rotavirus, RSV, HIV, norvovirus, adenovirus, and astrovirus | Ab 1 | US201200294822 SEQ ID NO: 4 | 3147 |
| BACG50 | Light chain, Antibody against *E. coli*, *Shigaella*, Entaamoeba histolvtica, *Salmonella*, *Campylobacter*, or *Clostridium difficile* or a virus selected from rotavirus, RSV, HIV, norvovirus, adenovirus, and astrovirus | Ab 2 | US201200294822 SEQ ID NO: 12 | 3148 |
| BACG51 | Light chain, Antibody against *E. coli*, *Shigaella*, Entaamoeba histolvtica, *Salmonella*, *Campylobacter*, or *Clostridium difficile* or a virus selected from rotavirus, RSV, HIV, norvovirus, adenovirus, and astrovirus | Ab 2 | US201200294822 SEQ ID NO: 14 | 3149 |

TABLE 5-continued

Antibodies against bacterial infections of the intestine

| Antibody No. | Description | Antibody Name | Reference Information | SEQ ID NO |
|---|---|---|---|---|
| BACG52 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 3 | US201200294822 SEQ ID NO: 22 | 3150 |
| BACG53 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 3 | US201200294822 SEQ ID NO: 24 | 3151 |
| BACG54 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 4 | US201200294822 SEQ ID NO: 32 | 3152 |
| BACG55 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 4 | US201200294822 SEQ ID NO: 34 | 3153 |
| BACG56 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 5 | US201200294822 SEQ ID NO: 42 | 3154 |
| BACG57 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 5 | US201200294822 SEQ ID NO: 44 | 3155 |
| BACG58 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 6 | US201200294822 SEQ ID NO: 52 | 3156 |
| BACG59 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 6 | US201200294822 SEQ ID NO: 54 | 3157 |
| BACG60 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 7 | US201200294822 SEQ ID NO: 62 | 3158 |
| BACG61 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 7 | US201200294822 SEQ ID NO: 64 | 3159 |
| BACG62 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 8 | US201200294822 SEQ ID NO: 72 | 3160 |
| BACG63 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 8 | US201200294822 SEQ ID NO: 74 | 3161 |
| BACG64 | Light chain, Antibody against E. coli, Shigaella, Entaamoeba histolytica, Salmonella, Campylobacter, or Clostridium difficile or a virus selected front rotavirus, RSV, HIV, norvovirus, adenovirus, and astrovirus | Ab 9 | US201200294822 SEQ ID NO: 82 | 3162 |
| BAC065 | Light chain, Antibody against E coli, Shigaella, Entaamoeba histolytica, Salmonella, Campylobacter, or Clostridium difficile or a virus selected from rotavirus, RSV, HIV, norvovirus, adenovirus, and astrovirus | Ab 9 | US201200294822 SEQ ID NO: 84 | 3163 |
| BACG66 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 10 | US201200294822 SEQ ID NO: 92 | 3164 |
| BACG67 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 10 | US201200294822 SEQ ID NO: 94 | 3165 |
| BACG68 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 11 | US201200294822 SEQ ID NO: 102 | 3166 |
| BACG69 | Light chain, Antibody against E. coli, Shigaella, Entaamoeba histolytica, Salmonella, Campylobacter, or Clostridium difficile or a virus selected from rotavirus, RSV, HIV, norvovirus, adenovirus, and astrovirus | Ab 11 | US201200294822 SEQ ID NO: 104 | 3167 |
| BACG70 | Light chain, Antibody against E. coli, Shigaella, Entaamoeba histolytica, Salmonella, Campylobacter, | Ab 12 | US201200294822 SEQ ID | 3168 |

TABLE 5-continued

Antibodies against bacterial infections of the intestine

| Antibody No. | Description | Antibody Name | Reference Information | SEQ ID NO |
|---|---|---|---|---|
| | or *Clostridium difficile* or a virus selected from rotavirus, RSV, HIV, norvovirus, adenovirus, and astrovirus | | NO: 112 | |
| BACG71 | Light chain, Antibody against *E. coli*, *Shigaella*, Entaamoeba histolytica, *Salmonella*, *Campylobacter*, or *Clostridium difficile* or a virus selected from rotavirus, RSV, HIV, norvovirus, adenovirus, and astrovirus | Ab 12 | US201200294822 SEQ ID NO: 114 | 3169 |
| BACG72 | Light chain, Antibody against *E. coli*, *Shigaella*, Entaamoeba histolytica, *Salmonella*, *Campylobacter*, or *Clostridium difficile* or a virus selected from rotavirus, RSV, HIV, norvovirus, adenovirus, and astrovirus | Ab 13 | US201200294822 SEQ ID NO: 122 | 3170 |
| BACG73 | Light chain, Antibody against *E. coli*, *Shigaella*, Entaamoeba histolytica, *Salmonella*, *Campylobacter*, or *Clostridium difficile* or a virus selected from rotavirus, RSV, HIV, norvovirus, adenovirus, and astrovirus | Ab 13 | US201200294822 SEQ ID NO: 124 | 3171 |
| BACG74 | Light chain, Antibody against *E. coli*, *Shigaella*, Entaamoeba histolytica, *Salmonella*, *Campylobacter*, or *Clostridium difficile* or a virus selected from rotavirus, RSV, HIV, norvovirus, adenovirus, and astrovirus | Ab 14 | US201200294822 SEQ ID NO: 132 | 3172 |
| BACG75 | Light chain, Antibody against *E. coli*, *Shigaella*, Entaamoeba histolytica, *Salmonella*, *Campylobacter*, or *Clostridium difficile* or a virus selected from rotavirus, RSV, HIV, norvovirus, adenovirus, and astrovirus | Ab 14 | US201200294822 SEQ ID NO: 134 | 3173 |
| BACG76 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab2 | WO2012162253 SEQ ID NO: 11 | 3174 |
| BACG77 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab3 | WO2012162253 SEQ ID NO: 22 | 3175 |
| BACG78 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab4 | WO2012162253 SEQ ID NO: 31 | 3176 |
| BACG79 | Light chain, Antibody against *E coli*, *Shigella*, Entaamoeba histolytica, *Salmonella*. *Campylobacter*, or *Clostridium difficile*, rotavirus, RSV, HIV, norvovirus, adenovirus, and astrovirus, other diseases causing diarrhea | Ab5 | WO2012162253 SEQ ID NO: 42 | 3177 |
| BACG80 | Light chain, Antibody against *E coli*, *Shigella*, Entaamoeba histolytica, *Salmonella*, *Campylobacter*, or *Clostidium difficile*, rotavirus, RSV, HIV, norvovirus, adenovirus, and astrovirus, other diseases causing diarrhea | Ab6 | WO2012162253 SEQ ID NO: 52 | 3178 |
| BACG81 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab7 | WO2012162253 SEQ ID NO: 61 | 3179 |
| BACG82 | Light chain, Antibody against *E coli*, *Shigella*, Entaamoeba histolytica, *Salmonella*. *Campylobacter*, or *Clostridium difficile*, rotavirus, RSV, HIV, norvovirus, adenovirus, and astrovirus, other diseases causing diarrhea | Ab8 | WO2012162253 SEQ ID NO: 71 | 3180 |
| BACG83 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab9 | WO2012162253 SEQ ID NO: 82 | 3181 |
| BACG84 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab10 | WO2012162253 SEQ ID NO: 91 | 3182 |
| BACG85 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab11 | WO2012162253 SEQ ID NO: 102 | 3183 |
| BACG86 | Light chain, Antibody against *E coli*, *Shigella*, Entaamoeba histolytica, *Salmonella*, *Campylobacter*, or | Ab12 | WO2012162253 SEQ ID | 3184 |

TABLE 5-continued

Antibodies against bacterial infections of the intestine

| Antibody No. | Description | Antibody Name | Reference Information | SEQ ID NO |
|---|---|---|---|---|
| | *Clostridium difficile*, rotavirus, RSV, HIV, norvovirus, adenovirus, and astrovirus, other diseases causing diarrhea | | NO: 112 | |
| BACG87 | Light chain, Antibody against *E coli*, *Shigella*, Entaamoeba histolytica, *Salmonella*, *Campylobacter*, or *Clostridium difficile*, rotavirus, RSV, HIV, notvovirus, adenovirus, and astrovirus, other diseases causing diarrhea | Ab13 | WO2012162253 SEQ ID NO: 122 | 3185 |
| BACG88 | Light chain, Antibody against *E coli*, *Shigella*, Entaamoeba histolytica, *Salmonella*, *Campylobacter*, or *Clostridium difficile*, rotavirus, RSV, HIV, norvovirus, adenovirus, and astrovirus, other diseases causing diarrhea | Ab14 | WO2012162253 SEQ ID NO: 132 | 3186 |
| BACG89 | Light chain, Antibody against *Escherichia coli* infection, *Staphylococcus* infection | | WO2014070117 SEQ ID NO: 4 | 3187 |
| BACG90 | Light chain, Antibody against *Listeria monocytogenes* or WR-tubercle bacillus | 6H8 | U.S. Pat. No. 8,445,643 SEQ ID NO: 6 | 3188 |
| BACG91 | Light chain, *Staphylococcus* enterotoxin B | F10 | U.S. Pat. No. 8,895,704 SEQ ID NO: 28 | 3189 |
| BACG92 | Light chain, *Staphylococcus* enterotoxin B | 100C9 | U.S. Pat. No. 8,895,704 SEQ ID NO: 32 | 3190 |
| BACG93 | Light chain, *Staphylococcus* enterotoxin B | 79G9 | U.S. Pat. No. 8,895,704 SEQ ID NO: 36 | 3191 |
| BACG94 | Light chain, *Staphylococcus* enterotoxin B | 154G12 | U.S. Pat. No. 8,895,704 SEQ ID NO: 134 | 3192 |
| BACG95 | ScFv, Antibody against *Clostridium perfringens*, anti-alpha toxin 1A8 | ScFv-1A8 | Zhao, B. and Xu, C. "Cloning and sequencing of the ScFv-2E3 gene anti-alpha toxin of *clostridium perfringens* type A", Chin. J. Vet. Sci. 20, 246-248 (2000), CNBI Accession # AAU11282 | 3193 |
| BACG96 | ScFv, Antibody against *Clostridium perfringens*, anti-alpha toxin 2E3 | ScFv-2E3 | Zhao, B. and Xu, C. "Cloning and sequencing of the ScFv-2E3 gene anti-alpha toxin of *clostridium perfringens* type A", Chin. J. Vet. Sci. 20, 246-248 (2000), NCBI Accession # AAU11283 | 3194 |
| BACG97 | Variable fragment, Antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, *Bacillus anthracis*, *Neisseria*, *Vibrio*, enterotoxic *E. coli*, *Salmonella*, *Shigella*, and *Listeria* bacteria | αTT2 | U.S. Pat. No. 7,655,759 SEQ ID NO: 8 | 3195 |
| BACG98 | Variable fragment, antibody against *Pseudomonas*, *Clostridium*, *Staphylococcus*, *Pasteurella*, *Yersinia*, *Bacillus anthracis*, *Neisseria*, *Vibrio*, enterotoxic *E. coli*, *Salmonella*, *Shigella*, and *Listeria*, *Clostridium*, *Staphylococcus*, *Pseudomonas*, *Pasteurella*, *Yersinia*, | αTT1 | U.S. Pat. No. 7,655,759 SEQ ID NO: 7 | 3196 |

TABLE 5-continued

| Antibodies against bacterial infections of the intestine | | | | |
|---|---|---|---|---|
| Antibody No. | Description | Antibody Name | Reference Information | SEQ ID NO |
| | *Bacillus anthracis*, *Neisseria*, *Vibrio*, enterotoxic *E. coli*, *Salmonella*, *Shigella*, and *Listeria* bacteria, | | | |

In one embodiment, the payload region of the AAV particle comprises one or more nucleic acid sequences encoding one or more of the payload antibody polypeptides listed in Table 6 against Hepatitis A and/or Hepatitis E.

TABLE 6

| Antibodies against Hepatitis A and Hepatitis E | | | | |
|---|---|---|---|---|
| Antibody No. | Description | Antibody Name | Reference Information | SEQ ID NO |
| HEPAE1 | Heavy chain variable region, HEV Ab, a humanized neutralizing genetically engineered antibody | HEV-Fab-216 | CN1486990A; CN100497391C | 3197 |
| HEPAE2 | Heavy chain variable region, HEV Ab, a humanized neutralizing genetically engineered antibody | HEV-Fab-315 | CN1486990A; CN100497391C | 3198 |
| HEPAE3 | Heavy chain variable region, HEV Ab, a humanized neutralizing genetically engineered antibody | HEV-Fab-319 | CN1486990A; CN100497391C | 3199 |
| HEPAE4 | Heavy chain variable region, HEV Ab, a humanized neutralizing genetically engineered antibody | HEV-Fab-328 | CN1486990A; CN100497391C | 3200 |
| HEPAE5 | Heavy chain variable region, HEV Ab, a humanized neutralizing genetically engineered antibody | HEV-Fab-404 | CN1486990A; CN100497391C | 3201 |
| HEPAE6 | Heavy chain variable region, HEV monoclonal antibody | 13D8 | US7786264 SEQ ID NO. 8; US20060233822; US20100003281; EP1452541; EP2322625 | 3202 |
| HEPAE7 | Heavy chain variable region, HEV monoclonal antibody | 16D7 | US7786264 SEQ ID NO. 20; US20060233822; US20100003281; EP1452541; EP2322625 | 3203 |
| HEPAE8 | Heavy chain variable region, HEV monoclonal antibody | 8C11 | US7786264 SEQ ID NO. 12; US20060233822; US20100003281; EP1452541; EP2322625 | 3204 |
| HEPAE9 | Heavy chain variable region, HEV monoclonal antibody | 8H3 | US7786264 SEQ ID NO. 16; US20060233822; US20100003281; EP1452541; EP2322625 | 3205 |
| HEPAE10 | Heavy chain variable region, HEV neutralizing antibody | HEV # 31 | US7148323 SEQ ID NO: 3; US20050233316; US6930176; WO2001040270 | 3206 |
| HEPAE11 | Heavy chain variable region, HEV neutralizing antibody | HEV # 4 | US7786264 SEQ ID NO: 1; US20050233316; US6930176; WO2001040270 | 3207 |
| HEPAE12 | Heavy chain variable region, partial, HAV | anti-HAV capsid | Kim S. J., et al., Neutralizing human monoclonal antibodies to hepatitis A virus recovered by phage display; Virology 318 (2), 598-607 (2004), NCBI Accession # AAO86899.1(124aa) | 3208 |
| HEPAE13 | Heavy chain variable region, partial. HAV | anti-HAV capsid | Kim S. J., et al., Neutralizing human monoclonal antibodies to hepatitis A virus recovered by phage display; Virology 318 (2), 598-607 (2004), NCBI Accession # AAO86898.1(129aa) | 3209 |
| HEPAE14 | Heavy chain variable region, partial, HAV | anti-HAV capsid | Kim S. J., et al., Neutralizing human monoclonal antibodies to hepatitis A virus recovered by phage display; Virology 318 (2), | 3210 |

TABLE 6-continued

Antibodies against Hepatitis A and Hepatitis E

| Antibody No. | Description | Antibody Name | Reference Information | SEQ ID NO |
|---|---|---|---|---|
| HEPAE15 | Heavy chain variable region, partial, HAV | anti-HA V capsid | 598-607 (2004), NCBI Accession # AAO86897.1(129aa) Kim S. J., et al., Neutralizing human monoclonal antibodies to hepatitis A virus recovered by phage display; Virology 318 (2), 598-607 (2004), NCBI Accession # AAO86896.1(129aa) | 3211 |
| HEPAE16 | Heavy chain, HEV antibody (mouse monoclonal antibody), E2 glycoprotein | 8g12 | Gu Y., et al., Structural basis for tire neutralization of hepatitis E virus by a cross-genotype antibody; Cell Res. 25 (5), 604-620 (2015); NCBI Accession # 4PLJ_H (229aa) | 3212 |
| HEPAE17 | Heavy chain, HEV antibody (mouse monoclonal antibody), E2 glycoprotein | | Tang X., et al., Proc. Natl. Acad. Sci. U.S.A. 108 (25), 10266-10271 (2011); NCBI Accession # 3RKD_H(230aa) | 3213 |
| HEPAE18 | Light chain variable region, gamma1, HAV, | HAV # 14 | US7635476 SEQ ID NO: 4; US7282205; US20040260067; US20070287667; WO2003040341 | 3214 |
| HEPAE19 | Light chain variable region, gamma1, HAV, | HAV # 4 | US7635476 SEQ ID NO: 1; US7282205; US20040260067; US20070287667; WO2003040341 | 3215 |
| HEPAE20 | Light chain variable region, gamma1, HAV, | HAV # 5 | US7635476 SEQ ID NO: 2; US7282205; US20040260067; US20070287667; WO2003040341 | 3216 |
| HEPAE21 | Light chain variable region, gamma1, HAV, | HAV # 6 | US7635476 SEQ ID NO: 3; US7282205; US20040260067; US20070287667; WO2003040341 | 3217 |
| HEPAE22 | Light chain variable region, HEV Ab, a humanized neutralizing genetically engineered antibody | HEV-Fab-216 | CN1486990A; CN100497391C | 3218 |
| HEPAE23 | Light chain variable region, HEV Ab, a humanized neutralizing genetically engineered antibody | HEV-Fab-315 | CN1486990A; CN100497391C | 3219 |
| HEPAE24 | Light chain variable region, HEV Ab, a humanized neutralizing genetically engineered antibody | HEV-Fab-319 | CN1486990A; CN100497391C | 3220 |
| HEPAE25 | Light chain variable region, HEV Ab, a humanized neutralizing genetically engineered antibody | HEV-Fab-328 | CN1486990A; CN100497391C | 3221 |
| HEPAE26 | Light chain variable region, HEV Ab, a humanized neutralizing genetically engineered antibody | HEV-Fab-404 | CN1486990A; CN100497391C | 3222 |
| HEPAE27 | Light chain variable region, monovalent, HAV | | WO2011114353 SEQ ID NO: 25 | 3223 |
| HEPAE28 | Light chain variable region, partial, HAV | anti-HAV capsid | Kim S. J., et al., Neutralizing human monoclonal antibodies to hepatitis A virus recovered by phage display; Virology 318 (2), 598-607 (2004), NCB1 Accession # AAO86903.1(107aa) | 3224 |
| HEPAE29 | Light chain variable region, partial, HAV | anti-HAV capsid | Kim S. J., el al., Neutralizing human monoclonal antibodies to hepatitis A virus recovered by phage display; Virology 318 (2), 598-607 (2004), NCBI Accession # AAO86902.1(107aa) | 3225 |
| HEPAE30 | Light cliain variable region, partial, HAV | anti-HAV capsid | Kim S. J., el al., Neutralizing human monoclonal antibodies to hepatitis A virus recovered by phage display; Virology 318 (2), 598-607 (2004), NCBI Accession # AAO86901.1(107aa) | |
| HEPAE31 | Light chain variable region, partial, HAV | anti-HAV capsid | Kim S. J., et al., Neutralizing human monoclonal antibodies to hepatitis A virus recovered by phage display; Virology 318 (2), 598-607 (2004). NCB I Accession # AAO86900.1(107aa) | |
| HEPAE32 | Light chain variable, HEV monoclonal antibody | 13D8 | US7786264 SEQ ID NO: 6; US20060233822; US20100003281; EP1452541; EP2322625 | 3228 |

TABLE 6-continued

Antibodies against Hepatitis A and Hepatitis E

| Antibody No. | Description | Antibody Name | Reference Information | SEQ ID NO |
|---|---|---|---|---|
| HEPAE33 | Light chain variable, HEV monoclonal antibody | 16D7 | US7786264 SEQ ID NO. 18; US20060233822; US20100003281; EP1452541; EP2322625 | 3229 |
| HEPAE34 | Light chain variable, HEV monoclonal antibody | 8C11 | US7786264 SEQ ID NO: 10; US20060233822; US20100003281; EP1452541; EP2322625 | 3230 |
| HEPAE35 | Light chain variable, HEV monoclonal antibody | 8H3 | US7786264 SEQ ID NO. 14; US20060233822; US20100003281; EP1452541; EP2322625 | 3231 |
| HEPAE36 | Light chain variable, HEV monoclonal antibody | HEV # 31 | US7148323 SEQ ID NO: 4; US20050233316; US6930176; WO2001040270 | 3232 |
| HEPAE37 | Light chain variable, HEV monoclonal antibody | HEV # 4 | US7148323 SEQ ID NO: 2; US20050233316; US6930176; WO2001040270 | 3233 |
| HEPAE38 | Light chain, E2 glycoprotein, HEV antibody (mouse monoclonal antibody) | 8g12 | Gu Y., et al., Structural basis for the neutralization of hepatitis E virus by a cross-genotype antibody; Cell Res. 25 (5), 604-620 (2015); NCBI Accession # 4PLJ_L (212aa) | 3234 |
| HEPAE39 | Light chain, E2 glycoprotein, HEV antibody (mouse monoclonal antibody) | | Tang X., et al., Proc. Natl. Acad. Sci. U.S.A. 108(25), 10266-10271 (2011), NCBI Accession # 3RKD_C (214aa) | 3235 |
| HEPAE40 | Monovalent Heavy chain variable region, HAV | | WO2011114353 SEQ ID NO: 24 | 3236 |
| HEPAE41 | ScFv, HAV, Monovalent human antibody | | WO2011114353 SEQ ID NO: 27 | 3237 |

In one embodiment, the payload region of the AAV particle comprises one or more nucleic acid sequences, fragment or variants thereof or encodes one or more polypeptides, fragments or variants thereof described in Chinese Pub. No. CN103923881, CN103923882, CN1605628, CN1318565, CN1163512, the contents of each of which are herein incorporated by reference in their entirety, against HAV.

In one embodiment, the payload region of the AAV particle comprises one or more nucleic acid sequences encoding one or more of the payload antibody polypeptides listed in Table 7 against Norwalk virus.

TABLE 7

Antibodies against Norwalk virus

| Antibody No. | Description | Antibody Name | Reference Information | SEQ ID NO |
|---|---|---|---|---|
| NORV1 | Heavy chain variable region, Norwalk virus | B7 | WO2014126921 SEQ ID NO: 8 | 3238 |
| NORV2 | Light chain variable region, Norwalk virus | B7 | WO2014126921 SEQ ID NO: 16 | 3239 |
| NORV3 | Heavy chain variable region, Norwalk virus | B72 | WO2014126921 SEQ ID NO: 120 | 3240 |
| NORV4 | Light chain variable region, Norwalk virus | B72 | WO2014126921 SEQ ID NO: 128 | 3241 |
| NORV5 | Heavy chain variable region, Norwalk virus | C9 | WO2014126921 SEQ ID NO: 88 | 3242 |
| NORV6 | Light chain variable region, Norwalk virus | C9 | WO2014126921 SEQ ID NO: 96 | 3243 |
| NORV7 | Heavy chain variable region, Norwalk virus | D4 | WO2014126921 SEQ ID NO: 136 | 3244 |
| NORV8 | Light chain variable region, Norwalk virus | D4 | WO2014126921 SEQ ID NO: 144 | 3245 |
| NORV9 | Heavy chain variable region, Norwalk virus | D8 | WO2014126921 SEQ ID NO: 24 | 3246 |
| NORV10 | Light chain variable region, Norwalk virus | D8 | WO2014126921 SEQ ID NO: 32 | 3247 |
| NORV1 | Heavy chain variable region, Norwalk virus | E5 | WO2014126921 SEQ ID NO: 40 | 3248 |
| NORV12 | Light chain variable region, Norwalk virus | E5 | WO2014126921 SEQ ID NO: 48 | 3249 |

TABLE 7-continued

Antibodies against Norwalk virus

| Antibody No. | Description | Antibody Name | Reference Information | SEQ ID NO |
|---|---|---|---|---|
| NORV13 | Heavy chain variable region, Norwalk virus | FI1 | WO2014126921 SEQ ID NO: 72 | 3250 |
| NORV14 | Light chain variable region, Norwalk virus | FI1 | WO2014126921 SEQ ID NO: 80 | 3251 |
| NORV15 | Heavy chain variable region, Norwalk virus | G3 | WO2014126921 SEQ ID NO: 104 | 3252 |
| NORV16 | Light chain variable region, Norwalk virus | G3 | WO2014126921 SEQ ID NO: 112 | 3253 |
| NORV17 | Heavy chain variable region, Norwalk virus | G4 | WO2014126921 SEQ ID NO: 56 | 3254 |
| NORV18 | Light chain variable region, Norwalk virus | G4 | WO2014126921 SEQ ID NO: 64 | 3255 |
| NORV19 | Heavy chain variable region, Norwalk or MD2004 virus | | WO2014183052 SEQ ID NO: 1 | 3256 |
| NORV20 | Heavy chain variable region, Norwalk or MD2004 virus | | WO2014183052 SEQ ID NO: 2 | 3257 |
| NORV21 | Heavy chain variable region, Norwalk or MD2004 virus | | WO2014183052 SEQ ID NO: 3 | 3258 |
| NORV22 | Heavy chain variable region, Norwalk or MD2004 virus | | WO2014183052 SEQ ID NO: 4 | 3259 |
| NORV23 | Heavy chain variable region, Norwalk or MD2004 virus | | WO2014183052 SEQ ID NO: 5 | 3260 |
| NORV24 | Heavy chain variable region, Norwalk or MD2004 virus | | WO2014183052 SEQ ID NO: 6 | 3261 |
| NORV25 | Heavy chain variable region, Norwalk or MD2004 virus | | WO2014183052 SEQ ID NO: 7 | 3262 |
| NORV26 | Heavy chain variable region, Norwalk or MD2004 virus | | WO2014183052 SEQ ID NO: 8 | 3263 |
| NORV27 | Heavy chain variable region, Norwalk or MD2004 virus | | WO2014183052 SEQ ID NO: 9 | 3264 |
| NORV28 | Heavy chain variable region, Norwalk or MD2004 virus | | WO2014183052 SEQ ID NO: 10 | 3265 |
| NORV29 | Heavy chain variable region, Norwalk or MD2004 virus | | WO2014183052 SEQ ID NO: 11 | 3266 |
| NORV30 | Heavy chain variable region, Norwalk or MD2004 virus | | WO2014183052 SEQ ID NO: 12 | 3267 |
| NORV31 | Heavy chain variable region, Norwalk or MD2004 virus | | WO2014183052 SEQ ID NO: 13 | 3268 |
| NORV32 | Heavy chain variable region, Norwalk or MD2004 virus | | WO2014183052 SEQ ID NO: 14 | 3269 |
| NORV33 | Heavy chain variable region, Norwalk or MD2004 virus | | WO2014183052 SEQ ID NO: 15 | 3270 |
| NORV34 | Heavy chain variable region, Norwalk or MD2004 virus | | WO2014183052 SEQ ID NO: 16 | 3271 |
| NORV35 | Heavy chain variable region, Norwalk or MD2004 virus | | WO2014183052 SEQ ID NO: 17 | 3272 |
| NORV36 | Heavy chain variable region, Norwalk or MD2004 virus | | WO2014183052 SEQ ID NO: 18 | 3273 |
| NORV37 | Heavy chain variable region, Norwalk or MD2004 virus | | WO2014183052 SEQ ID NO: 19 | 3274 |
| NORV38 | Heavy chain variable region, Norwalk or MD2004 virus | | WO2014183052 SEQ ID NO: 20 | 3275 |
| NORV39 | Heavy chain variable region, Norwalk or MD2004 virus | | WO2014183052 SEQ ID NO: 21 | 3276 |
| NORV40 | Heavy chain variable region, Norwalk or MD2004 virus | | WO2014183052 SEQ ID NO: 22 | 3277 |
| NORV41 | Heavy chain variable region, Norwalk or MD2004 virus | | WO2014183052 SEQ ID NO: 23 | 3278 |
| NORV42 | Heavy chain variable region, Norwalk or MD2004 virus | | WO2014183052 SEQ ID NO: 24 | 3279 |
| NORV43 | Heavy chain variable region, Norwalk or MD2004 virus | | WO2014183052 SEQ ID NO: 25 | 3280 |
| NORV44 | Heavy chain variable region, Norwalk or MD2004 virus | | WO2014183052 SEQ ID NO: 26 | 3281 |
| NORV45 | Heavy chain variable region, Norwalk or MD2004 virus | | WO2014183052 SEQ ID NO: 27 | 3282 |
| NORV46 | Heavy chain variable region, Norwalk or MD2004 virus | | WO2014183052 SEQ ID NO: 28 | 3283 |
| NORV47 | Heavy chain variable region, Norwalk or MD2004 virus | | WO2014183052 SEQ ID NO: 29 | 3284 |
| NORV48 | Heavy chain variable region, Norwalk or MD2004 virus | | WO2014183052 SEQ ID NO: 30 | 3285 |

In one embodiment, the payload region of the AAV particle comprises one or more nucleic acid sequences encoding one or more of the payload antibody polypeptides listed in Table 8 against Rotavirus.

TABLE 8

Antibodies against rotavirus

| Antibody No. | Description | Reference Information | SEQ ID NO |
|---|---|---|---|
| ROTV1 | Heavy chain single domain | US8105592; US20090226418 SEQ ID NO: 1 | 3286 |
| ROTV2 | Heavy chain single domain | US8105592; US20090226418 SEQ ID NO: 2 | 3287 |
| ROTV3 | Heavy chain single domain | US8105592; US20090226418 SEQ ID NO: 3 | 3288 |
| R0TV4 | Heavy chain single domain | US8105592; US20090226418 SEQ ID NO: 4 | 3289 |
| ROTV5 | Heavy chain single domain | US8105592; US20090226418 SEQ ID NO: 5 | 3290 |
| ROTV6 | Heavy chain single domain | US8105592; US20090226418 SEQ ID NO: 6 | 3291 |
| ROTV7 | Heavy chain single domain | US8105592; US20090226418 SEQ ID NO: 7 | 3292 |
| ROTV8 | Heavy chain single domain | US8105592; US20090226418 SEQ ID NO: 8 | 3293 |
| ROTV9 | Heavy chain single domain | US8105592; US20090226418 SEQ ID NO: 9 | 3294 |
| ROTV10 | Heavy chain single domain | US8105592; US20090226418 SEQ ID NO: 10 | 3295 |
| ROTV11 | Heavy chain single domain | US8105592; US20090226418 SEQ ID NO: 11 | 3296 |
| ROTV12 | Heavy chain single domain | US8105592; US20090226418 SEQ ID NO: 12 | 3297 |
| ROTV13 | Heavy chain single domain | US8105592; US20090226418 SEQ ID NO: 13 | 3298 |
| ROTV14 | Heavy chain single domain | US8105592; US20090226418 SEQ ID NO: 14 | 3299 |
| ROTV15 | Heavy chain single domain | US8105592; US20090226418 SEQ ID NO: 15 | 3300 |
| ROTV16 | Heavy chain single domain | US8105592; US20090226418 SEQ ID NO: 16 | 3301 |
| ROTV17 | Heavy chain single domain | US8105592; US20090226418 SEQ ID NO: 17 | 3302 |
| ROTV18 | Heavy chain single domain | US8105592; US20090226418 SEQ ID NO: 18 | 3303 |
| ROTV19 | Heavy chain single domain | US8105592; US20090226418 SEQ ID NO: 19 | 3304 |
| ROTV20 | Heavy chain single domain | US8105592; US20090226418 SEQ ID NO: 20 | 3305 |
| ROTV21 | Heavy chain single domain | US8105592; US20090226418 SEQ ID NO: 21 | 3306 |
| ROTV22 | Human VP6 polypeptide | US20030166139 SEQ ID NO: 2 | 3307 |
| ROTV23 | Human VP6 polypeptide | US20030166139 SEQ ID NO: 4 | 3308 |
| ROTV24 | | Aiyegbo, M. S., et al "Human RotavirUSVp6-Specific Antibodies Mediate intracellular Neutralization By Binding To A Quater Structure in The Transcriptional Pore", Plos One 8, 61101 (2013), NCBI Accession # 4HFW_B | 3309 |
| ROTV25 | | Aiyegbo, M. S., et al "Human RotavirUSVp6-Specific Antibodies Mediate intracellular Neutralization By Binding To A Quater Structure in The Transcriptional Pore", Plos One 8, 61101 (2013), NCBI Accession # 4HFW_B | 3310 |

In one embodiment, the payload region of the AAV particle comprises one or more nucleic acid sequences encoding one or more of the payload antibody polypeptides listed in Table 9 against *Entamoeba histolytica*.

TABLE 9

Antibodies against Entainoeba Histolytica

| Antibody No.; Antibody Name | Description | Reference Information | SEQ ID NO |
|---|---|---|---|
| ENTH1 | Heavy chain (partial sequence) gamma., Entamoeba histolytica antibody | Cheng, X. J. et al., Exp. Parasitol. 96 (1), 52-56 (2000), NCBI Accession # BAA97670.1 (220aa) | 3311 |
| ENTH2 | Heavy chain (partial sequence) gamma, Entamoeba histolytica Antibody | Tachibana, H. et al., Clin. Diagn. Lab. Immunol. 6 (3), 383-387 (1999), NCBI Accession # BAA82104.1 (222aa) | 3312 |
| ENTH3 | Heavy chain (partial sequence) gamma, Entamoeba histolytica Antibody | Tachibana, H. et al., Clin. Diagn. Lab. Immunol. 6 (3), 383-387 (1999), NCBI Accession # BAA82101.1 (226aa) | 3313 |
| ENTH4 | Heavy chain (partial sequence) IgG, Entamoeba histolytica Intermediate Subunit Lectin-Specific Human Monoclonal Antibodies | Tachibana, H., et al., Infect. Immun. 77 (1), 549-556 (2009), NCBI Accession # BAH03695.1 (220aa) | 3314 |
| ENTH5 | Heavy chain (partial sequence) IgG, Entamoeba histolytica Intermediate Subunit Lectin-Specific Human Monoclonal Antibodies | Tachibana, H., el al., Infect. Immun. 77 (1), 549-556 (2009), NCBI Accession # BAH03694.1 (226aa) | 3315 |
| ENTH6 | Heavy chain (partial sequence) IgG, Entamoeba histolytica Intermediate Subunit Lectin-Specific Human Monoclonal Antibodies | Tachibana, H., et al., Infect. Immun. 77 (1), 549-556(2009), NCBI Accession # BAH03693.1 (221aa) | 3316 |

TABLE 9-continued

Antibodies against Entainoeba Histolytica

| Antibody No.; Antibody Name | Description | Reference Information | SEQ ID NO |
|---|---|---|---|
| ENTH7 | Heavy chain (partial sequence) IgG, Entamoeba histolytica Intermediate Subunit Lectin-Specific Human Monoclonal Anybodies | Tachibana. H., et al., Infect. Immun. 77 (1), 549-556 (2009), NCBI Accession # BAH03692.1 (223aa) | 3317 |
| ENTH8 | Light chain (partial sequence) IgG, Entamoeba histolytica intermediate Subunit Lectin-Specific Human Monoclonal Antibodies | Tachibana, H., et al., Infect. Immun. 77 (1), 549-556 (2009), NCBI Accession # BAH03699.1 (219aa) | 3318 |
| ENTH9 | Light chain (partial sequence) IgG, Entamoeba histolytica Intermediate Subunit Lectin-Specific Human Monoclonal Antibodies | Tachibana. H., et al., Infect. Immun. 77 (1), 549-556 (2009), NCBI Accession # BAH03698.1 (220aa) | 3319 |
| ENTH10 | Light chain (partial sequence) IgG, Entamoeba histolytica Intermediate Subunit Lectin-Specific Human Monoclonal Antibodies | Tachibana, H., et al., Infect. Immun. 77 (1), 549-556 (2009), NCBI Accession # BAH03697.1 (214aa) | 3320 |
| ENTH11 | Light chain (partial sequence) IgG, Entamoeba histolytica Intermediate Subunit Lectin-Specific Human Monoclonal Antibodies | Tachibana, H., et al., Infect. Immun. 77 (1), 549-556 (2009), NCBI Accession # BAH03696.1 (214aa) | 3321 |
| ENTH12 | Light chain (partial sequence) kappa, Entamoeba histolytica antibody | Cheng, X. J. et al., Exp. Parasitol. 96 (1), 52-56 (2000), NCBI Accession # BAA97671.1 (214aa) | 3322 |
| ENTH13 | Light chain (partial sequence) kappa, Entamoeba histolytica antibody | Tachibana, H. et al., Clin. Diagn. Lab. Immunol. 6 (3), 383-387 (1999), NCBI Accession # BAA821051 (215aa) | 3323 |
| ENTH14 | Light chain (partial sequence) kappa, Entamoeba histolytica antibody | Tachibana, H. et al., Clin. Diagn. Lab. Immunol. 6 (3), 383-387 (1999), NCBI Accession # BAA82100.1 (214aa) | 3324 |
| ENTH15/ 350-E2 | Single chain Fv Antibody 350-E2 against Entamoeba histolytica | NCBI Accession # AEY80059.1 (274aa) | 3325 |
| ENTH16/ JR4A11 | Single chain Fv Antibody JR4A11 Entamoeba histolytica | NCBI Accession # AEY80058.1 (287aa) | 3326 |

In one embodiment, the payload region of the AAV particle comprises one or more nucleic acid sequences encoding one or more of the payload antibody polypeptides, fragments or variants thereof described in International Pub. No. WO2001012646, the contents of which are herein incorporated by reference in their entirety, against listena monocytogenes, salmonella and/or leishmania.

Neglected Tropical Diseases

In one embodiment, the payload region of the AAV particle comprises one or more nucleic acid sequences encoding one or more of the neglected tropical disease related payload antibody polypeptides listed in Tables 10-13.

In one embodiment, the payload region of the AAV particle comprises one or more nucleic acid sequences encoding one or more of the payload antibody polypeptides listed in Table 10 against Dengue Fever Virus.

TABLE 10

| Antibodies against Dengue Fever Virus | | | | |
|---|---|---|---|---|
| Antibody No. | Description | Antibody Name | Reference Information | SEQ ID NO |
| DENG1 | Bispecific, DENV serotype 1, DENV serotype 2, DENV serotype 3, and DENV serotype 4 | m366 | US20150218255 SEQ ID NO: 96 | 3327 |
| DENG2 | Fab Fragment | Fab 14c10 | Teoh, E. P., el al., Sci Transl Med 4 (139), 139RA83 (2012), NCBI Accession # 4CAU_E(230 aa) | 3328 |
| DENG3 | Heavy chain | 5j7 Fab | Fibriansah, G., el al., A highly potent human antibody neutralizes dengue virus serotype 3 by binding across three surface proteins; Nat Commun 6, 6341 (2015), NCBI Accession # 3J6U_H (135aa) | 3329 |
| DENG4 | Heavy Chain | Ede1 C8 | Dejnirattisai, W., et al., A new class of highly potent, broadly neutralizing antibodies isolated from viremic patients infected with dengue virus; Nat. Immunol. 16 (2), 170-177 (2015), NCBI Accession # 4UTA_H (272 aa) | 3330 |

TABLE 10-continued

Antibodies against Dengue Fever Virus

| Antibody No. | Description | Antibody Name | Reference Information | SEQ ID NO |
|---|---|---|---|---|
| DENG5 | Heavy Chain | Fab 2h12 | Midgley, C.M., et al., J, Immunol. 188 (1), 4971-4979 (2012), NCBI Accession # 4AL8_H (217 aa) | 3331 |
| DENG6 | Heavy Chain Fab Fragment Of Antibody 1f4 | 1f4 Fab | Fibriansah. G., et al., A potent anti-dengue human antibody preferentially recognizes the conformation of E protein monomers assembled on the virus surface; EMBO Mol Med 6 (3), 358-371 (2014), NCBI Accession # 4C2I_H (232 aa) | 3332 |
| DENG7 | Heavy chain variable region | 9F12 | WO2010093335 SEQ ID NO: 4 | 3333 |
| DENG8 | Heavy chain variable region, DENV serotype 1, DENV serotype 2, DENV serotype 3, and DENV serotype 4 | 9F12 | US20150218255 SEQ ID NO: 83 | 3334 |
| DENG9 | Heavy chain variable region, DENV serotype 1, DENV serotype 2, DENV serotype 3, and DENV serotype 4 | m366 | US20150218255 SEQ ID NO: 4 | 3335 |
| DENG10 | Heavy chain variable region, DENV serotype 1, DENV serotype 2, DENV serotype 3, and DENV serotype 4 | m366.6 | US20150218255 SEQ ID NO: 24 | 3336 |
| DENG11 | Heavy chain variable region, DENV serotype 1, DENV serotype 2, DENV serotype 3, and DENV serotype 4 | m360.6 | US20150218255 SEQ ID NO: 44 | 3337 |
| DENG12 | Heavy chain variable region, DENV-I, DENV-2, DENV-3, DENV-4 | HMB-DV-1 | US9073981 SEQ ID NO: 13 | 3338 |
| DENG13 | Heavy chain variable region, DENV-I, DENV-2, DENV-3, DENV-4 | HMB-DV-2 | US9073981 SEQ ID NO: 29 | 3339 |
| DENG14 | Heavy chain variable region, DENV-I, DENV-2, DENV-3, DENV-4 | HMB-DV-3 | US9073981 SEQ ID NO: 45 | 3340 |
| DENG15 | Heavy chain variable region, DENV-I, DENV-2, DENV-3, DENV-4 | HMB-DV-4 | US9073981 SEQ ID NO: 61 | 3341 |
| DENG16 | Heavy chain variable region, DENV-I, DENV-2, DENV-3, DENV-4 | HMB-DV-4 | US9073981 SEQ ID NO: 65 | 3342 |
| DENG17 | Heavy chain variable region, DENV-I, DENV-2, DEN V-3, DENV-4 | HMB-DV-5 | US9073981 SEQ ID NO: 79 | 3343 |
| DENG18 | Heavy chain variable region, DENV-I, DENV-2, DENV-3, DENV-4 | HMB-DV-6, HMB-DV-7 | US9073981 SEQ ID NO: 95 | 3344 |
| DENG19 | Heavy chain variable region, DENV-I, DENV-2, DENV-3, DENV-4 | HMB-DV-8 | US9073981 SEQ ID NO: 117 | 3345 |
| DENG20 | Heavy chain variable region, DENV-I, DENV-2, DENV-3, DENV-4 | HMB-DV-9 | US9073981 SEQ ID NO: 131 | 3346 |
| DENG21 | Heavy chain variable region, DENV-I, DENV-2, DENV-3, DENV-4 | HMB-DV-10 | US9073981 SEQ ID NO: 145 | 3347 |
| DENG22 | Heavy chain variable region, DENV-I, DENV-2, DENV-3, DENV-4 | HMB-DV-11 | US9073981 SEQ ID NO: 151 | 3348 |
| DENG23 | Heavy chain variable region, DENV-I, DENV-2, DENV-3, DENV-4 | HMB-DV-12 | US9073981 SEQ ID NO: 165 | 3349 |
| DENG24 | Heavy chain variable region, DENV-I, DENV-2, DENV-3, DENV-4 | HMB-DV-13 | US9073981 SEQ ID NO: 181 | 3350 |
| DENG25 | Heavy chain variable region, DENV-I, DENV-2, DENV-3, DENV-4 | HMB-DV-14 | US9073981 SEQ ID NO: 195 | 3351 |
| DENG26 | Heavy chain variable region, DV-1, DV-2, DV-3, and DV-10 | A68 | US20150225474 SEQ ID NO: 19 | 3352 |
| DENG27 | Heavy chain variable region, DV-1, DV-2, DV-3, and DV-11 | A100 | US20150225474 SEQ ID NO: 20 | 3353 |

TABLE 10-continued

Antibodies against Dengue Fever Virus

| Antibody No. | Description | Antibody Name | Reference Information | SEQ ID NO |
|---|---|---|---|---|
| DENG28 | Heavy chain variable region, DV-1, DV-2, DV-3, and DV-12 | C58 | US20150225474 SEQ ID NO: 21 | 3354 |
| DENG29 | Heavy chain variable region, DV-1, DV-2, DV-3, and DV-13 | C98 | US20150225474 SEQ ID NO: 32 | 3355 |
| DENG30 | Heavy chain variable region, DV-1, DV-2, DV-3, and DV-14 | A11 | US20150225474 SEQ ID NO: 33 | 3356 |
| DENG31 | Heavy chain variable region, DV-1, DV-2, DV-3, and DV-15 | B11 | US20150225474 SEQ ID NO: 36 | 3357 |
| DENG32 | Heavy chain variable region, DV-1, DV-2, DV-3, and PV-4 | D88 | US20150225474 SEQ ID NO: 1 | 3358 |
| DENG33 | Heavy chain variable region, DV-1, DV-2, PV-3, and DV-1 | mAb11 | WO2014144061 SEQ ID NO: 1 | 3359 |
| DENG34 | Heavy chain variable region, DV-1, DV-2, DV-3, and PV-5 | F38 | US20150225474 SEQ ID NO: 80 | 3360 |
| DENG35 | Heavy chain variable region, DV-1, DV-2, PV-3. and DV-6 | A48 | US20150225474 SEQ ID NO: 16 | 3361 |
| DENG36 | Heavy drain variable region, DV-1, DV-2, PV-3, and DV-7 | C8S | US20150225474 SEQ ID NO: 17 | 3362 |
| DENG37 | Heavy chain variable region, DV-1, DV-2, DV-3, and PV-8 | F108 | US20150225474 SEQ ID NO: 18 | 3363 |
| DENG38 | Heavy chain variable region, DV-1, DV-2, PV-3, and PV-9 | B48 | US20150225474 SEQ ID NO: 18 | 3364 |
| DENG39 | Heavy chain, Antigen-binding Fragment Of Human Antibody 2d22 | 2d22 | Fibriansah, G., et al., DENGUE VIRUS. Cryo-EM structure of an antibody that neutralizes dengue virus type 2 by locking E protein dimers; Science 349 (6243), 88-91 (2015), NCBI Accession # 5A1Z_K (128 aa) | 3365 |
| DENG40 | Heavy chain, Dengue virus NS-1 protein | | US7473424; US20040209244; WO2004067567; EP1592712 SEQ ID NO: 3 | 3366 |
| DENG41 | Heavy chain, Dengue virus serotype 2 | DB32-6 | US8637035 SEQ ID NO: 1 | 3367 |
| DENG42 | Heavy chain, Dengue virus serotype 2 | DB2-3 | US8637035 SEQ ID NO: 13 | 3368 |
| DENG43 | Heavy chain, Dengue virus serotype 2 | DB13-19 | US8637035 SEQ ID NO: 14 | 3369 |
| DENG44 | Heavy chain, Dengue virus serotype 2 | DB23-3 | US8637035 SEQ ID NO: 15 | 3370 |
| DENG45 | Heavy chain. Dengue virus serotype 2 | DB25-2 | US8637035 SEQ ID NO: 16 | 3371 |
| DENG46 | Heavy chain, Dengue virus serotype 2 | DB42-3 | US8637035 SEQ ID NO: 17 | 3372 |
| DENG47 | Heavy chain, Dengue virus type 10 | 1A5 | US8337853 SEQ ID NO: 97 | 3373 |
| DENG48 | Heavy chain. Dengue virus type 11 | 2H7 | US8337853 SEQ ID NO: 113 | 3374 |
| DENG49 | Heavy chain, Dengue virus type 12 | 2H5 | US8337853 SEQ ID NO: 129 | 3375 |
| DENG50 | Heavy chain, Dengue virus type 13 | 3A2 | US20130089543 SEQ ID NO: 145 | 3376 |
| DENG51 | Heavy chain, Dengue virus type 14 | 1B2 | US20130089543 SEQ ID NO: 161 | 3377 |
| DENG52 | Heavy chain. Dengue virus type 13 | 1A10 | US20130089543 SEQ ID NO: 177 | 3378 |
| DENG53 | Heavy chain, Dengue virus type 4 | 5H2 | US7622113 SEQ ID NO: 1 | 3379 |
| DENG54 | Heavy chain, Dengue virus type 5 | 5H7 | US7622113 SEQ ID NO: 17 | 3380 |
| DENG55 | Heavy chain, Dengue vires type 6 | 3Cl | US7622113 SEQ ID NO: 33 | 3381 |
| DENG56 | Heavy chain, Dengue virus type 7 | 3E4 | US7622113 SEQ ID NO: 49 | 3382 |
| DENG57 | Heavy chain, Dengue virus type 8 | 7G4 | US7622113 SEQ ID NO: 65 | 3383 |
| DENG58 | Heavy chain, Dengue virus type 9 | 5D9 | US7622113 SEQ ID NO: 81 | 3384 |
| DENG59 | Heavy chain, DV 1 | 14c10 clone 8 | US20130259871 Fig 4b | 3385 |
| DENG60 | Heavy chain, DV-1, DV-2, DV-3, and DV-4 | Antibody 4e11 | US20140056913 SEQ ID NO: 1 | 3386 |
| DENG61 | Heavy chain, DV-1, DV-2, DV-3, and DV-4 | Variant of 4E11 | US20140056913 SEQ ID NO: 21 | 3387 |
| DENG62 | Heavy chain, DV-1, DV-2, DV-3, and DV-4 | 4E5A | WO20155123362 SEQ ID NO: 29 | 3388 |
| DENG63 | Light Chain | 5j7 Fab | Fibriansah, G., et al., A highly potent human antibody neutralizes dengue virus serotype 3 by binding | 3389 |

TABLE 10-continued

Antibodies against Dengue Fever Virus

| Antibody No. | Description | Antibody Name | Reference Information | SEQ ID NO |
|---|---|---|---|---|
| DENG64 | Light Chain | Ede1 C8 | across three surface proteins; Nat Commun 6, 6341 (2015), NCBI Accession # 3J6U_L (118aa) Dejnirattisai, W., et al., A new class of highly potent, broadly neutralizing antibodies isolated from viremic patients infected with dengue virus; Nat. Immunol. 16 (2), 170-177 (2015), NCBI Accession # 4UTA_L (217 aa) | 3390 |
| DENG65 | Light Chain | Fab 2h12 | Midgley, C. M., et al., J, Immunol. 188 (10), 4971-4979 (2012), NCBI Accession # 4AL8_L (213 aa) | 3391 |
| DENG66 | Light Chain Fab Fragment Of Antibody 1f4 | 1f4 Fab | Fibriansah, G., et al., A potent anti-dengue human antibody preferentially recognizes the conformation of E protein monomers assembled on the virus surface; EMBO Mol Med 6 (3), 358-371 (2014), NCBI Accession # 4C2I_N (239 aa) | 3392 |
| DENG67 | Light chain variable region | 9F12 | WO2010093335 SEQ ID NO: 6 | |
| DENG68 | Light chain variable region, DENV serotype 1, DENV serotype 2, DENV serotype 3, and DENV serotype 4 | 9F12 | US20150218255 SEQ ID NO: 84 | 3393 |
| DENG69 | Light chain variable region, DENV serotype 1, DENV serotype 2, DENV serotype 3, and DENV serotype 4 | m366 | US20150218255 SEQ ID NO: 6 | 3394 |
| DENG70 | Light chain variable region, DENV serotype 1, DENV serotype 2, DENV serotype 3, and DENV serotype 4 | m366.6 | US20150218255 SEQ ID NO: 26 | 3395 |
| DENG71 | Light chain variable region, DENV serotype 1, DENV serotype 2, DENV serotype 3, and DENV serotype 4 | m360.6 | US20150218255 SEQ ID NO: 46 | 3396 |
| DENG72 | Light chain variable region, DENV-I, DENV-2, DENV-3, DENV-4 | HMB-DV-1 | US9073981 SEQ ID NO: 14 | 3397 |
| DENG73 | Light chain variable region, DENV-I, DENV-2, DENV-3, DENV-4 | HMB-DV-2 | US9073981 SEQ ID NO: 30 | 3398 |
| DENG74 | Light chain variable region, DENV-I, DENV-2, DENV-3, DENV-4 | HMB-DV-3 | US9073981 SEQ ID NO: 46 | 3399 |
| DENG75 | Light chain variable region, DENV-I, DENV-2, DENV-3, DENV-4 | HMB-DV-4 | US9073981 SEQ ID NO: 62 | 3401 |
| DENG76 | Light chain variable region, DENV-I, DENV-2, DENV-3, DENV-4 | HMB-DV-5 | US9073981 SEQ ID NO: 80 | 3402 |
| DENG77 | Light chain variable region, DENV-I, DENV-2, DENV-3, DENV-4 | HMB-DV-6 | US9073981 SEQ ID NO: 96 | 3403 |
| DENG78 | Light chain variable region, DENV-I, DENV-2, DENV-3, DENV-4 | HMB-DV-7 | US9073981 SEQ ID NO: 103 | 3404 |
| DENG79 | Light chain variable region, DENV-I, DENV-2, DENV-3, DENV-4 | HNfB-DV-8 | US9073981 SEQ ID NO: 118 | 3405 |
| DENG80 | Light chain variable region, DENV-I, DENV-2, DENV-3, DENV-4 | HMB-DV-9 | US9073981 SEQ ID NO: 132 | 3406 |
| DENG81 | Light chain variable region, DENV-I, DENV-2, DENV-3, DENV-4 | HMB-DV-10, HMB-DV-11 | US9073981 SEQ ID NO: 146 | 3407 |
| DENG82 | Light chain variable region, DENV-I, DENV-2, DENV-3, DENV-4 | HMB-DV-12 | US9073981 SEQ ID NO: 166 | 3408 |
| DENG83 | Light chain variable region, DENV-I, DENV-2, DENV-3, DENV-4 | HMB-DV-13 | US9073981 SEQ ID NO: 182 | 3409 |

TABLE 10-continued

Antibodies against Dengue Fever Virus

| Antibody No. | Description | Antibody Name | Reference Information | SEQ ID NO |
|---|---|---|---|---|
| DENG84 | Light chain variable region, DENV-I, DENV-2, DENV-3, DENV-4 | HMB-DV-14 | US9073981 SEQ ID NO: 196 | 3410 |
| DENG85 | Light chain variable region, DV-1, DV-2, DV-3, and DV-4 | D88, F38, A48, C88, F108, B48, A68, A100, C58, C78, C68, D98, D188, C128, C98 | US20150225474 SEQ ID NO: 2 | 3411 |
| DENG86 | Light chain variable region, DV-1, DV-2, DV-3, and DV-4 | C78 | US20S50225474 SEQ ID NO: 23 | 3412 |
| DENG87 | Light chain variable region, DV-1, DV-2, DV-3, and DV-4 | C68 | US20150225474 SEQ ID NO: 25 | 3413 |
| DENG88 | Light chain variable region, DV-1, DV-2, DV-3, and DV-4 | D98 | US20150225474 SEQ ID NO: 27 | 3414 |
| DENG89 | Light chain variable region, DV-1, DV-2, DV-3, and DV-4 | D188 | US20150225474 SEQ ID NO: 29 | 3415 |
| DENG90 | Light chain variable region, DV-1, DV-2, DV-3, and DV-4 | C128 | US20150225474 SEQ ID NO: 31 | 3416 |
| DENG91 | Light chain variable region, DV-1, DV-2, DV-3, and DV-4 | A11, B11 | US20150225474 SEQ ID NO: 34 | 3417 |
| DENG92 | Light chain variable region, DV-1, DV-2, DV-3, and DV-4 | mAb11 | WO2014144061 SEQ ID NO: 3 | 3418 |
| DENG93 | Light chain, Antigen-binding Fragment Of Human Antibody 2d22 | 2d22 | Fibriansah, G., el al., DENGUE VIRUS. Cryo-EM structure of an antibody that neutralizes dengue virus type 2 by locking E protein dimers; Science 349 (6243), 88-91 (2015), NCBI Accession # 5A1Z_L (115 aa) | 3419 |
| DENG94 | Light cliain, Dengue virus NS-1 protein | | US7473424; US20040209244; WO2004067567; EP1592712 SEQ ID NO: 4 | 3420 |
| DENG95 | Light chain, Dengue virus serotype 2 | DB32-6 | US8637035 SEQ ID NO: 5 | 3421 |
| DENG96 | Light chain, Dengue virus serotype 2 | DB2-3, DB-19 | US8637035 SEQ ID NO: 19 | 3422 |
| DENG97 | Light chain, Dengue virus serotype 2 | DB23-3 | US8637035 SEQ ID NO: 20 | 3423 |
| DENG98 | Light chain, Dengue virus serotype 2 | DB25-2 | US8637035 SEQ ID NO: 21 | 3424 |
| DENG99 | Light chain, Dengue virus serotype 2 | DB42-3 | US8637035 SEQ ID NO: 22 | 3425 |
| DENG100 | Light chain, Dengue virus serotype 4 | 5H2 | US7622113 SEQ ID NO: 9 | 3426 |
| DENG101 | Light chain, Dengue virus serotype 4 | 5A7 | US7622113 SEQ ID NO: 25 | 3427 |
| DENG102 | Light chain, Dengue virus serotype 4 | 3C1 | US7622113 SEQ ID NO: 41 | 3428 |
| DENG103 | Light chain, Dengue virus serotype 4 | 3E4 | US7622113 SEQ ID NO: 57 | 3429 |
| DENG104 | Light chain, Dengue virus serotype 4 | 7G4 | US7622113 SEQ ID NO: 73 | 3430 |
| DENG105 | Light chain, Dengue virus serotype 4 | 5D9 | US7622153 SEQ II) NO: 89 | 3431 |
| DENG106 | Light chain, Dengue virus serotype 4 | 1A5 | US8337853 SEQ ID NO: 105 | 3432 |
| DENG107 | Light chain, Dengue virus serotype 4 | 2H7 | US8337853 SEQ ID NO: 121 | 3433 |
| DENG108 | Light chain, Dengue virus serotype 4 | 2H5 | US8337853 SEQ ID NO: 137 | 3434 |
| DENG109 | Light chain, Dengue virus serotype 4 | 3A2 | US20130089543 SEQ ID NO: 153 | 3435 |
| DENG110 | Light chain, Dengue virus serotype 4 | 1B2 | US20130089543 SEQ ID NO: 169 | 3436 |
| DENG111 | Light chain, Dengue virus serotype 4 | 1A10 | US20130089543 SEQ ID NO: 185 | 3437 |
| DENG112 | Light chain, DV 1 | 14c10 clone 8 | US20130259871 Fig 4b | 3438 |
| DENG113 | Light chain, DV-l, DV-2, DV-3, and DV-4 | Antibody 4e11 | US20140056913 SEQ ID NO: 2 | 3439 |
| DENG114 | Light chain, DV-l, DV-2, DV-3, and DV-4 | Variant of 4E11 | US20140056913 SEQ ID NO: 22 | 3440 |

TABLE 10-continued

Antibodies against Dengue Fever Virus

| Antibody No. | Description | Antibody Name | Reference Information | SEQ ID NO |
|---|---|---|---|---|
| DENG115 | Light chain, DV-1, DV-2, DV-3, and DV-4 | 4E5A | WO20155123362 SEQ ID NO: 30 | 3441 |
| DENG116 | scFv | 9F12 | WO2010093335 SEQ ID NO: 8 | 3442 |
| DENG117 | Scfv Fragment | Ede211 | Dejnirattisai, W., et al., A new class of highly potent, broadly neutralizing antibodies isolated from viremic patients infected with dengue virus; Nat. Immunol. 16 (2), 170-177 (2015), NCBI Accession # 4UT7_L(153 aa) | 3443 |
| DENG118 | Scfv Fragment | Ede2 A11 | Dejnirattisai, W., et al, A new class of highly potent, broadly neutralizing antibodies isolated from viremic patients infected with dengue virus; Nat. Immunol. 16 (2), 170-177 (2015), NCBI Accession # 4UT7_H (150 aa) | 3444 |
| DENG119 | | Ede2A11 | Dejnirattisai, W., et al., A new class of lightly potent, broadly neutralizing antibodies isolated from viremic patients infected with dengue virus; Nat. Immunol. 16 (2), 170-177 (2015), NCBI Accession # 4UTB_L (218 aa) | 3445 |
| DENG120 | | Ede1 C10 | Dejnirattisai, W., et al., A new class of highly potent, broadly neutralizing antibodies isolated from viremic patients infected with dengue virus; Nat. Immunol. 16 (2), 170-177 (2015), NCBI Accession # 4UT9_L (154aa) | 3446 |
| DENG121 | | Ede1 C10 | Dejnirattisai, W., et al., A new class of highly potent, broadly neutralizing antibodies isolated from viremic patients infected with dengue virus; Nat. Immunol 16 (2), 170-177 (2015), NCBI Accession # 4UT9_H (144 aa) | 3447 |
| DENG122 | | Ede2 B7 | Dejnirattisai. W. et al., A new class of highly potent, broadly neutralizing antibodies isolated from viremic patients infected with dengue virus; Nat. Immunol. 16 (2), 170-177 (2015), NCBI Accession # 4UT6_L (218 aa) | 3448 |
| DENG123 | | Ede2 B7 | Dejnirattisai, W., et al., A new class of highly potent, broadly neutralizing antibodies isolated from viremic patients injected with dengue virus; Nat. Immunol. 16 (2), 170-177 (2015), NCBI Accession # 4UT6_H (283 aa) | 3449 |

In one embodiment, the payload region of the AAV particle comprises one or more nucleic acid sequences encoding one or more of the payload antibody polypeptides, fragments or variants thereof described in International Pub. No. WO2013089647 and WO2013035345, U.S. Pat. Nos. 8,637,035 and 887,187, US Publication No. US20050123900, and Chinese Patent Publication No. CN102757480, the contents of which are herein incorporated by reference in their entirety, against *Listeria monocytogenes*, salmonella and/or leishmania.

In one embodiment, the payload region of the AAV particle comprises one or more nucleic acid sequences encoding one or more of the payload antibody polypeptides listed in Table 11 against Rabies Virus

TABLE 11

| Antibodies against Rabies Virus | | | | |
|---|---|---|---|---|
| Antibody No. | Description | Antibody Name | Reference Information | SEQ ID NO |
| RABV1 | Fab Heavy Chain Fd region | | CN101696242 SEQ ID NO: 9 | 3450 |
| RABV2 | Fab Light chain | | CN101696242 SEQ ID NO: 10 | 3451 |
| RABV3 | Heavy chain | | US6890532 SEQ ID NO: 3 | 3452 |

TABLE 11-continued Antibodies against Rabies Virus

| Antibody No. | Description | Antibody Name | Reference Information | SEQ ID NO |
|---|---|---|---|---|
| RABV4 | Heavy chain | Mab JB.1 | US7071319 SEQ ID NO: 10 | 3453 |
| RABV5 | Heavy chain | Mab 57 | US7071319 SEQ ID NO: 14 | 3454 |
| RABV6 | Heavy chain | CR04-098 | US9005624 SEQ ID NO: 335 | 3455 |
| RABV7 | Heavy chain | CR57, Rafivirumab | US9005624 SEQ ID NO: 123 | 3456 |
| RABV8 | Heavy chain | CR57, Rafivirumab | | |
| RABV9 | Heavy chain | CRJB | US9005624 SEQ ID NO: 127 | 3458 |
| RABV10 | Heavy chain | Foravirumab | | 3459 |
| RABV11 | Heavy chain, Anti-rabies SOJB immunoglobulin | | Presniak, M. et al. "Development of a cocktail of recombinant-expressed human rabies virus-neutralizing monoclonal antibodies for postexposure prophylaxis of rabies", J. Infect. Dis. 188 (1), 53-56 (2003), NCBI Accession # AAO17822.1 | 3460 |
| RABV12 | Heavy chain variable region | | CN101696242 SEQ ID NO: 4 | 3461 |
| RABV13 | Heavy chain variable region | SC04-001 | US9005624 SEQ ID NO: 26 | 3462 |
| RABV14 | Heavy chain variable region | SC04-004 | US9005624 SEQ ID NO: 27 | 3463 |
| RABV15 | Heavy chain variable region | SC04-008 | US9005624 SEQ ID NO: 28 | 3464 |
| RABV16 | Heavy chain variable region | SC04-010 | US9003624 SEQ ID NO: 29 | 3465 |
| RABV17 | Heavy chain variable region | SC04-018 | US9005624 SEQ ID NO: 30 | 3466 |
| RABV18 | Heavy chain variable region | SC04-021 | US9005624 SEQ ID NO: 31 | 3467 |
| RABV19 | Heavy chain variable region | SC04-026 | US9005624 SEQ ID NO: 32 | 3468 |
| RABV20 | Heavy chain variable region | SC04-031 | US9005624 SEQ ID NO: 33 | 3469 |
| RABV21 | Heavy chain variable region | SC04-038 | US9005624 SEQ ID NO: 44 | 3470 |
| RABV22 | Heavy chain variable region | SC04-040 | US9005624 SEQ ID NO: 35 | 3471 |
| RABV23 | Heavy chain variable region | SC04-060 | US9005624 SEQ ID NO: 36 | 3472 |
| RABV24 | Heavy chain variable region | SC04-073 | US9005624 SEQ ID NO: 37 | 3473 |
| RABV25 | Heavy chain variable region | SC04-097 | US9005624 SEQ ID NO: 38 | 3474 |
| RABV26 | Heavy chain variable region | SC04-098 | US9005624 SEQ ID NO: 39 | 3475 |
| RABV27 | Heavy chain variable region | SC04-103 | US9005624 SEQ ID NO: 40 | 3476 |
| RABV28 | Heavy chain variable region | SC04-104 | US9005624 SEQ ID NO: 41 | 3477 |
| RABV29 | Heavy chain variable region | SC04-108 | US9005624 SEQ ID NO: 42 | 3478 |
| RABV30 | Heavy chain variable region | SC04-120 | US9005624 SEQ ID NO: 43 | 3479 |
| RABV31 | Heavy chain variable region | SC04-125 | US9005624 SEQ ID NO: 44 | 3480 |
| RABV32 | Heavy chain variable region | SC04-126 | US9005624 SEQ ID NO: 45 | 3481 |
| RABV33 | Heavy chain variable region | SC04-140 | US9005624 SEQ ID NO: 46 | 3482 |
| RABV34 | Heavy chain variable region | SC04-144 | US9005624 SEQ ID NO: 47 | 3483 |
| RABV35 | Heavy chain variable region | SC04-146 | US9005624 SEQ ID NO: 48 | 3484 |
| RABV36 | Heavy chain variable region | SC04-164 | US9005624 SEQ ID NO: 49 | 3485 |
| RABV37 | Heavy chain variable region | RVFab5 | WO201113757 SEQ ID NO: 2 | 3486 |
| RABV38 | Heavy chain variable region | RVFab8 | WO2011137570 SEQ ID NO: 2 | 3487 |
| RABV39 | Heavy chain variable region | | CN101337990 SEQ ID NO: 2 | 3488 |
| RABV40 | Heavy chain variable region | | CN101337990 SEQ ID NO: 8 | 3489 |
| RABV41 | Heavy chain variable region | R8 VH | CN104193823 SEQ ID NO: 1 | 3490 |
| RABV42 | Heavy chain variable region | R5 VH | CN104193823 SEQ ID NO: 2 | 3491 |
| RABV43 | Heavy chain variable region | R7 VH, R9 VH | CN104193823 SEQ ID NO: 3 | 3492 |
| RABV44 | Heavy chain variable region | | CN101235086 SEQ ID NO: 38 | 3493 |
| RABV45 | Heavy chain, Anti-rabies SOJA immunoglobulin | | Prosniak, M. et al. "Development of a cocktail of recombinant-expressed human rabies virus-neutralizing monoclonal antibodies for postexposnre prophylaxis of rabies", J. Infect. Dis. 188 (1), 53-56 (2003), NCBI Accession # AAO17823.1 | 3494 |
| RABV46 | Light chain | | US6890532 SEQ ID NO: 4 | 3495 |
| RABV47 | Light chain | Mab JB.1 | US7071319 SEQ ID NO: 12 | 3496 |
| RABV48 | Light chain | Mab 57 | US7071319 SEQ ID NO: 16 | 3497 |
| RABV49 | Light chain | CR04-098 | US9005624 SEQ ID NO: 337 | 3498 |
| RABV50 | Light chain | CR57, Rafivirumab | US9005624 SEQ ID NO: 125 | 3499 |
| RABV51 | Light chain | CR57, Rafivirumab | | 3500 |
| RABV52 | Light chain | CRJB | US9005624 SEQ ID NO: 129 | 3501 |
| RABV53 | Light chain | Foravirumab | | 3502 |
| RABV54 | Light chain Kappa, Anti-rabies SOJA immunoglobulin | | Prosniak, M. et al. "Development of a cocktail of recombinant-expressed human rabies virus-neutralizing monoclonal antibodies for | 3503 |

TABLE 11-continued

Antibodies against Rabies Virus

| Antibody No. | Description | Antibody Name | Reference Information | SEQ ID NO |
|---|---|---|---|---|
| RABV55 | Light chain kappa, Anti-rabies SOJA immunoglobulin [Homo sapiens] | | Prosniak, M. et al. "Development of a cocktail of recombinant-expressed human rabies virus-neutralizing monoclonal antibodies for postexposnre prophylaxis of rabies", J. Infect. Dis. 188 (1), 53-56 (2003), NCBI Accession # AAO17825.1 | 3504 |
| RABV56 | Light chain Lambda, Anti-rabies S057 immunoglobulin | | Prosniak, M. et al. "Development of a cocktail of recombinant-expressed human rabies virus-neutralizing monoclonal antibodies for postexposnre prophylaxis of rabies", J. Infect. Dis. 188 (1), 53-56 (2003), NCBI Accession # AAO17821.1 | 3505 |
| RABV57 | Light cliain lambda, Anti-rabies SOJB immunoglobulin | | Prosniak, M. et al. "Development of a cocktail of recombinant-expressed human rabies virus-neutralizing monoclonal antibodies for postexposnre prophylaxis of rabies", J. Infect. Dis. 188 (1), 53-56 (2003), NCBI Accession # AAO17824.1 | 3506 |
| | | | Prosniak, M. et al. "Development of a cocktail of recombinant-expressed human rabies virus-neutralizing monoclonal antibodies for postexposnre prophylaxis of rabies", J. Infect. Dis. 188 (1), 53-56 (2003), NCBI Accession # AAO17826.1 | |
| RABV58 | Light chain variable region | SC04-001 | US9005624 SEQ ID NO: 50 | 3507 |
| RABV59 | Light chain variable region | SC04-00-1 | US9005624 SEQ ID NO: 51 | 3508 |
| RABV60 | Light chain variable region | SC04-008 | US9005624 SEQ ID NO: 52 | 3509 |
| RABV61 | Light chain variable region | SC04-010 | US9005624 SEQ ID NO: 55 | 3510 |
| RABV62 | Light chain variable region | SC04-018 | US9005624 SEQ ID NO: 54 | 3511 |
| RABV63 | Light chain variable region | SC04-021 | US9005624 SEQ ID NO: 55 | 3512 |
| RABV64 | Light chain variable region | SC04-026 | US9005624 SEQ ID NO: 56 | 3513 |
| RABV65 | Light chain variable region | SC04-031 | US9005624 SEQ ID NO: 57 | 3514 |
| RABV66 | Light chain variable region | SC04-038 | US9005624 SEQ ID NO: 58 | 3515 |
| RABV67 | Light chain variable region | SC04-040 | US9005624 SEQ ID NO: 59 | 3516 |
| RABV68 | Light chain variable region | SC04-060 | US9005624 SEQ ID NO: 60 | 3517 |
| RABV69 | Light chain variable region | SC04-073 | US9005624 SEQ ID NO: 61 | 3518 |
| RABV70 | Light chain variable region | SC04-097 | US9005624 SEQ ID NO: 62 | 3519 |
| RABV71 | Light chain variable region | SC04-098 | US9005624 SEQ ID NO: 63 | 3520 |
| RABV72 | Light chain variable region | SC04-103 | US9005624 SEQ ID NO: 64 | 3521 |
| RABV73 | Light chain variable region | SC04-104 | US9005624 SEQ ID NO: 65 | 3522 |
| RABV74 | Light chain variable region | SC04-108 | US9005624 SEQ ID NO: 66 | 3523 |
| RABV75 | Light chain variable region | SC04-120 | US9005624 SEQ ID NO: 67 | 3524 |
| RABV76 | Light chain variable region | SC04-125 | US9005624 SEQ ID NO: 68 | 3525 |
| RABV77 | Light chain variable region | SC04-126 | US9005624 SEQ ID NO: 69 | 3526 |
| RABV78 | Light chain variable region | SC04-140 | US9005624 SEQ ID NO: 70 | 3527 |
| RABV79 | Light chain variable region | SC04-144 | US9005624 SEQ ID NO: 71 | 3528 |
| RABV80 | Light chain variable region | SC04-146 | US9005624 SEQ ID NO: 72 | 3529 |
| RABV81 | Light chain variable region | SC04-164 | US9005624 SEQ ID NO: 73 | 3530 |
| RABV82 | Light chain variable region | RVFab5 | WO201113757 SEQ ID NO: 1 | 3531 |
| RABV83 | Light chain variable region | RVFab8 | WO2011137570 SEQ ID NO: 1 | 3432 |
| RABV84 | Light chain variable region | | CN101337990 SEQ ID NO: 4 | 3433 |
| RABV85 | Light chain variable region | | CN101337990 SEQ ID NO: 10 | 3434 |
| RABV86 | Light chain variable region | R8 VL | CN104193823 SEQ ID NO: 4 | 3435 |
| RABV87 | Light chain variable region | R5 VL | CN104193823 SEQ ID NO: 5 | 3436 |
| RABV88 | Light chain variable region | R7 VL | CN104193823 SEQ ID NO: 6 | 3437 |
| RABV89 | Light chain variable region | R9 VL | CN104193823 SEQ ID NO: 7 | 3438 |
| RABV90 | Light chain variable region | | CN101696242 SEQ ID NO: 8 | 3439 |
| RABV91 | Light chain variable region | | CN101235086 SEQ ID NO: 39 | 3440 |

In one embodiment, the payload region of the AAV particle comprises one or more nucleic acid sequences encoding one or more of the payload antibody polypeptides listed in Table 12 against Chagas Virus.

TABLE 12

Antibodies against Chagas Virus

| Antibody No. | Description | Reference Information | SEQ ID NO |
|---|---|---|---|
| CHAG1 | Heavy Chain Of The Fab Fragment, Trypanosoma cruzi trans-sialidase | Buschiazzo et al., PLoS Pathol. 8 (1), E1002474 (2012), NCBI Accession # 3OPZ_J (222aa) | 3541 |
| CHAG2 | Light chain of Fab fragment, Trypanosoma cmzi trans-sialidase | Buschiazzo et al., PLoS Pathog. 8 (1), E1002474 (2012), NCBI Accession # 3OPZ_N (213aa) | 3542 |

In one embodiment, the payload region of the AAV particle comprises one or more nucleic acid sequences encoding one or more of the payload antibody polypeptides listed in Table 13 against Chikungunya Virus.

TABLE 13

Antibodies against Chikungunya Virus

| Antibody No. | Description | Antibody Name | Reference Information | SEQ ID NO |
|---|---|---|---|---|
| CHIK1 | Heavy chain Fab fragment | 9.8b | Sun, S. et al., Structural analyses at pseudo atomic resolution of Chikungunya virus and antibodies show mechanisms of neutralization, Elife 2, E00435 (2013), NCBI Accession # 4GO9_H (218 aa) | 3543 |
| CHIK2 | Heavy chain variable | 5F101717E2 | US20130189279 SEQ ID NO: 6 | 3544 |
| CHIK3 | Heavy chain variable | 8B10F8 | US20130189279 SEQ ID NO: 26 | 3545 |
| CHIK4 | Light chain Fab fragment | 9.8b | Sun, S. et al., Structural analyses at pseudo atomic resolution of Chikungunya virus and antibodies show mechanisms of neutralization, Elife 2, E00435 (2013), NCBI Accession # 4GO9_L (212 aa) | 3546 |
| CHIK5 | Light chain variable | 5F10F175E2 | US20130189279 SEQ ID NO: 8 | 3547 |
| CHIK6 | Light chain variable | 8B10F8 | US20130189279 SEQ ID NO | 3548 |

In one embodiment, the payload region of the AAV particle comprises one or more nucleic acid sequences, fragment or variants thereof or encodes one or more polypeptides, fragments or variants thereof encoding antibodies described International Pub No. WO1983001785 and U.S. Pat. No. 5,827,671, the contents of each of which are herein incorporated by reference in their entirety, against the protozoan parasite Leishmania.

In one embodiment, the payload region of the AAV particle comprises one or more nucleic acid sequences, fragment or variants thereof or encodes one or more polypeptides, fragments or variants thereof encoding antibodies against the Buruli ulcer (*Mycobacterium ulcerans*), Leprosy/Hansen's disease (*Mycobacterium leprae*), Leishmaniasis, Cysticercosis, Dracunculiasis (Guinea Worm Disease), Echinococcosis, Fascioliasis, Human African Trypanosomiasis (African Sleeping Sickness), Lymphatic filariasis, Onchocerciasis, Schistosomiasis, Soil-transmitted Helminths (STH).

Toxins

In one embodiment, the payload region of the AAV particle comprises one or more nucleic acid sequences encoding one or more of the toxin related payload antibody polypeptides listed in Tables 14-17.

In one embodiment, the payload region of the AAV particle comprises one or more nucleic acid sequences encoding one or more of the payload antibody polypeptides listed in Table 14 against Ricin Toxin.

TABLE 14

Antibodies against Ricin Toxin

| Antibody No. | Description | Antibody Name | Reference Information | SEQ ID NO |
|---|---|---|---|---|
| RICN1 | Candid heavy-chain only | RTA:JIV-F5 | WO2015100409 SEQ ID NO: 124 | 3549 |
| RICN2 | Candid heavy-chain only | JIV-F6 | WO2015100409 SEQ ID NO: 126 | 3550 |
| RICN3 | Candid heavy-chain only | JIV-G 12 | WO2015100409 SEQ ID NO: 128 | 3551 |
| RICN4 | Candid heavy-chain only | JIY-A7 | WO2015100409 SEQ ID NO: 130 | 3552 |
| RICN5 | Candid heavy-chain only | JIY-D9 | WO2015100409 SEQ ID NO: 132 | 3553 |
| RICN6 | Candid heavy-chain only | JIY-D10 | WO2015100409 SEQ ID NO: 134 | 3554 |
| RICN7 | Candid heavy-chain only | JIY-E1 | WO2015100409 SEQ ID NO: 136 | 3555 |
| RICN8 | Candid heavy-chain only | JIY-E3 | WO2015100409 SEQ ID NO: 138 | 3556 |
| RICN9 | Candid heavy-chain only | JIY-E5 | WO2015100409 SEQ ID NO: 140 | 3557 |

TABLE 14-continued

Antibodies against Ricin Toxin

| Antibody No. | Description | Antibody Name | Reference Information | SEQ ID NO |
|---|---|---|---|---|
| RICN10 | Candid heavy-chain only | JIY-F10 | WO2015100409 SEQ ID NO: 142 | 3558 |
| RICN11 | Candid heavy-chain only | JIY-G11 | WO2015100409 SEQ ID NO: 144 | 3559 |
| RICN12 | Candid heavy-chain only | RTB:JIW-B1 | WO2015100409 SEQ ID NO: 146 | 3560 |
| RICN13 | Candid heavy-chain only | JIW-C12 | WO2015100409 SEQ ID NO: 148 | 3561 |
| RICN14 | Candid heavy-chain only | JIW-D12 | WO2015100409 SEQ ID NO: 150 | 3562 |
| RICN15 | Candid heavy-chain only | JIW-G5 | WO2015100409 SEQ ID NO: 152 | 3563 |
| RICN16 | Candid heavy-chain only | JIW-G 10 | WO2015100409 SEQ ID NO: 154 | 3564 |
| RICN17 | Candid heavy-chain only | JIZ-B7 | WO2015100409 SEQ ID NO: 156 | 3565 |
| RICN18 | Candid heavy-chain only | JIZ-B9 | WO2015100409 SEQ ID NO: 158 | 3566 |
| RICN19 | Candid heavy-chain only | JIZ-D8 | WO2015100409 SEQ ID NO: 160 | 3567 |
| RICN20 | Candid heavy-chain only | JIZ-G4 | WO2015100409 SEQ ID NO: 162 | 3568 |

In one embodiment, the payload region of the AAV particle comprises one or more nucleic acid sequences encoding one or more of the payload antibody polypeptides listed in Table 15 against Anthrax.

TABLE 15

| Antibody No. | Description | Antibody Name | Reference Information | SEQ ID NO |
|---|---|---|---|---|
| Antibodies against Anthrax | | | | |
| ANTH1 | Camelid heavy-chain only | JHD-B6 | WO2015100409 SEQ ID NO: 100 | 3569 |
| ANTH2 | Camelid heavy-chain only | JHE-D9 | WO2015100409 SEQ ID NO: 102 | 3570 |
| ANTH3 | Camelid heavy-chain only | JIJ-A12 | WO2015100409 SEQ ID NO: 104 | 3571 |
| ANTH4 | Camelid heavy-chain only | JIJ-B8 | WO2015100409 SEQ ID NO: 106 | 3572 |
| ANTH5 | Camelid heavy-chain only | JIJ-C11 | WO2015100409 SEQ ID NO: 108 | 3573 |
| ANTH6 | Camelid heavy-chain only | JIJ-D3 | WO2015100409 SEQ ID NO: 110 | 3574 |
| ANTH7 | Camelid heavy-chain only | JIJ-E9 | WO2015100409 SEQ ID NO: 112 | 3575 |
| ANTH8 | Camelid heavy-chain only | JIJ-F11 | WO2015100409 SEQ ID NO: 114 | 3576 |
| ANTH9 | Camelid heavy-chain only | JIK-B8 | WO2015100409 SEQ ID NO: 116 | 3577 |
| ANTH10 | Camelid heavy-chain only | JI-B 10 | WO2015100409 SEQ ID NO: 118 | 3578 |
| ANTH11 | Camelid heavy-chain only | JIK-B 12 | WO2015100409 SEQ ID NO: 120 | 3579 |
| ANTH12 | Camelid heavy-chain only | JIK-F4 | WO2015100409 SEQ ID NO: 122 | 3580 |
| ANTH13 | CDR | | WO2003063768 SEQ ID NO: 1 | 3581 |
| ANTH14 | CDR | | WO2003063768 SEQ ID NO: 2 | 3582 |
| ANTH15 | CDR | | WO2003063768 SEQ ID NO: 3 | 3583 |
| ANTH16 | Heavy chain | | US8617548 SEC ID NO: 2 | 3584 |
| ANTH17 | Heavy chain | IQNPA Lambda | US7658925 SEQ ID NO: 2 | 3585 |
| ANTH18 | Heavy chain | IQNLF Lambda | US7658925 SEQ ID NO: 6 | 3586 |
| ANTH19 | Heavy chain | 1A5 | US20090022736 SEQ ID NO: 1 | 3587 |
| ANTH20 | Heavy chain | 4A12 | US20090022736 SEQ ID NO: 3 | 3588 |
| ANTH21 | Heavy chain | 24B1 | US20090022736 SEQ ID NO: 5 | 3589 |
| ANTH22 | Heavy chain | 24G4 | US20090022736 SEQ ID NO: 7 | 3590 |
| ANTH23 | Heavy chain | 32E12 | US20090022736 SEQ ID NO: 9 | 3591 |
| ANTH24 | Heavy chain | 33F4 | US20090022736 SEQ ID NO: 11 | 3592 |
| ANTH25 | Heavy chain | scfv 2LF | EP2778173 SEQ ID NO: 9 | 3593 |
| ANTH26 | Heavy chain | | US20040258699 SEQ ID NO: 78 | 3594 |
| ANTH27 | Heavy chain | | US20040258699 SEQ ID NO: 79 | 3595 |
| ANTH28 | Heavy chain | | US20040258699 SEQ ID NO: 80 | 3596 |
| ANTH29 | Heavy chain | | US20040258699 SEQ ID NO: 81 | 3597 |
| ANTH30 | Heavy chain | | US20040258699 SEQ ID NO: 82 | 3598 |
| ANTH31 | Heavy chain | | US20040258699 SEQ ID NO: 83 | 3599 |
| ANTH32 | Heavy chain | | US20040258699 SEQ ID NO: 84 | 3600 |
| ANTH33 | Heavy chain | | US20040258699 SEQ ID NO: 85 | 3601 |
| ANTH34 | Heavy chain | | US20040258699 SEQ ID NO: 86 | 3602 |
| ANTH35 | Heavy chain | | US20040258699 SEQ ID NO: 87 | 3603 |
| ANTH36 | Heavy chain | | US20040258699 SEQ ID NO: 88 | 3604 |
| ANTH37 | Heavy chain | | US20040258699 SEQ ID NO: 89 | 3605 |
| ANTH38 | Heavy chain | | US20040258699 SEQ ID NO: 90 | 3606 |
| ANTH39 | Heavy chain | | US20040258699 SEQ ID NO: 91 | 3607 |
| ANTH40 | Heavy chain | | US20040258699 SEQ ID NO: 92 | 3608 |
| ANTH41 | Heavy chain | | US20040258699 SEQ ID NO: 93 | 3609 |
| ANTH42 | Heavy chain | | US20040258699 SEQ ID NO: 94 | 3610 |
| ANTH43 | Heavy chain | | US20040258699 SEQ ID NO: 95 | 3611 |
| ANTH44 | Heavy chain | | US20040258699 SEQ ID NO: 96 | 3612 |
| ANTH45 | Heavy chain | | US20040258699 SEQ ID NO: 97 | 3613 |
| ANTH46 | Heavy chain | | US20040258699 SEQ ID NO: 98 | 3614 |
| ANTH47 | Heavy chain | | US20040258699 SEQ ID NO: 99 | 3615 |
| ANTH48 | Heavy chain | | US20040258699 SEQ ID NO: 100 | 3616 |
| ANTH49 | Heavy chain | | US20040258699 SEQ ID NO: 101 | 3617 |
| ANTH50 | Heavy chain | | US20040258699 SEQ ID NO: 102 | 3618 |
| ANTH51 | Heavy chain | | US20040258699 SEQ ID NO: 103 | 3619 |
| ANTH52 | Heavy chain | | US20040258699 SEQ ID NO: 104 | 3620 |
| ANTH53 | Heavy chain | | US20040258699 SEQ ID NO: 105 | 3621 |
| ANTH54 | Heavy chain | | US20040258699 SEQ ID NO: 106 | 3622 |
| ANTH55 | Heavy chain | | US20040258699 SEQ ID NO: 107 | 3623 |
| ANTH56 | Heavy chain | | US20040258699 SEQ ID NO: 108 | 3624 |
| ANTH57 | Heavy chain | | US20040258699 SEQ ID NO: 109 | 3625 |
| ANTH58 | Heavy chain | | US20040258699 SEQ ID NO: 110 | 3626 |
| ANTH59 | Heavy chain | | US20040258699 SEQ ID NO: 111 | 3627 |
| ANTH60 | Heavy chain | | US20040258699 SEQ ID NO: 112 | 3628 |
| ANTH61 | Heavy chain | | US20040258699 SEQ ID NO: 113 | 3629 |
| ANTH62 | Heavy chain | | US20040258699 SEQ ID NO: 114 | 3630 |
| ANTH63 | Heavy chain | | US20040258699 SEQ ID NO: 115 | 3631 |
| ANTH64 | Heavy chain | | US20040258699 SEQ ID NO: 116 | 3632 |
| ANTH65 | Heavy chain | | US20040258699 SEQ ID NO: 117 | 3633 |
| ANTH66 | Heavy chain | | US20040258699 SEQ ID NO: 118 | 3634 |
| ANTH67 | Heavy chain and light chain variable region | 14B7 scFV | US7902344; US6916474 SEQ ID NO: 21 | 3635 |
| ANTH68 | Heavy chain fd region | W1 | US8685396 SEQ ID NO: 1 | 3636 |
| ANTH69 | Heavy chain fd region | W2 | US8685396 SEQ ID NO: 17 | 3637 |
| ANTH70 | Heavy chain | W5 | US8685396 SEQ ID NO: 33 | 3638 |
| ANTH71 | Heavy chain | A63-6 | US8685396 SEQ ID NO: 34 | 3639 |
| ANTH72 | Heavy chain | F3-6 | US8685396 SEQ ID NO: 35 | 3640 |
| ANTH73 | Heavy chain | F5-1 | US8685396 SEQ ID NO: 36 | 3641 |
| ANTH74 | Heavy chain variable region | ETI-204 | US2010156196 SEQ ID NO: 1 | 3642 |

TABLE 15-continued

Antibodies against Anthrax

| Antibody No. | Description | Antibody Name | Reference Information | SEQ ID NO |
|---|---|---|---|---|
| ANTH75 | Heavy chain variable region | 6.20 | WO2015107307 SEQ ID NO: 1 | 3643 |
| ANTH76 | Heavy chain variable region | 33PA83 | WO2009071860 SEQ ID NO: 1 | 3644 |
| ANTH77 | Heavy chain variable region | anti-γDPGA antibody | US8501182 SEQ ID NO: 1 | 3645 |
| ANTH78 | Heavy chain variable region | 4C | US8501182 SEQ ID NO: 3 | 3646 |
| ANTH79 | Heavy chain variable region | 11D | US8501182 SEQ ID NO: 5 | 3647 |
| ANTH80 | Heavy chain variable region | F20G75 | WO2007131363 SEQ ID NO: 16 | 3648 |
| ANTH81 | Heavy chain variable region | F20G76 | WO2007131363 SEQ ID NO: 18 | 3649 |
| ANTH82 | Heavy chain variable region | F20G77 | WO2007131363 SEQ ID NO: 20 | 3650 |
| ANTH83 | Heavy chain variable region | V2 variant | US8507655 SEQ ID NO: 7 | 3651 |
| ANTH84 | Heavy chain variable region | 6.20 variant | US8507655 SEQ ID NO: 9 | 3652 |
| ANTH85 | Heavy chain variable region | J24.15 variant | US8507653 SEQ ID NO: 11 | 3653 |
| ANTH86 | Heavy chain variable region | J24.7 variant | US8507655 SEQ ID NO: 13 | 3654 |
| ANTH87 | Heavy chain variable region | V2 variant human | US85076S5 SEQ ID NO: 15 | 3655 |
| ANTH88 | Heavy chain variable region | 6.20 variant human | US8S07655 SEQ ID NO: 17 | 3656 |
| ANTH89 | Heavy chain variable region | J24.15 variant human | US8507655 SEQ ID NO: 19 | 3657 |
| ANTH90 | Heavy chain variable region | J24.7 variant human | US8507655 SEQ ID NO: 21 | 3658 |
| ANTH91 | Heavy chain variable region | HuMab 5E8 | US8404820 SEQ ID NO: 2 | 3659 |
| ANTH92 | Heavy chain variable region | HnMab 2D5 | US8404820 SEQ ID NO: 8 | 3660 |
| ANTH93 | Heavy chain variable region | HuMab 2H4 | US8404820 SEQ ID NO: 12 | 3661 |
| ANTH94 | Heavy chain variable region | HuMab 5D5-2E10 | US8404820 SEQ ID NO: 16 | 3662 |
| ANTH95 | Heavy chain variable region | 13E3 | US8309P9P SEQ ID NO: 2 | 3663 |
| ANTH96 | Heavy chain variable region | 3E1 | US8309090 SEQ ID NO: 6 | 3667 |
| ANTH97 | Heavy chain variable region | KCTC 10756BP | US8268316 SEQ ID NO: 2 | 3665 |
| ANTH98 | Heavy chain variable region | M18 scFv | US7902344; US69I6474 SEQ ID NO: 23 | 3666 |
| ANTH99 | Heavy chain variable region | 21D9 MAb | US7442373 SEQ ID NO: 2 | 3667 |
| ANTH100 | Heavy chain variable region | 1C6 Mab | US7442373 SEQ ID NO: 6 | 3668 |
| ANTH101 | Heavy chain variable region | 4H7 Mab | US7442373 SEQ ID NO: 10 | 3669 |
| ANTH102 | Heavy chain variable region | 22G12 Mab | US7442373 SEQ ID NO: 14 | 3670 |
| ANTH103 | Heavy chain variable region | monoclonal antibody 9-1 | WO1999055842 SEQ ID NO: 20 | 3671 |
| ANTH104 | Heavy chain variable region | monoclonal antibody 7-1 | WO1999055842 SEQ ID NO: 21 | 3672 |
| ANTH105 | Heavy chain variable region | monoclonal antibody 24-2 | WO1999055842 SEQ ID NO: 22 | 3673 |
| ANTH106 | Heavy chain variable region | monoclonal antibody 21-4 | WO1999055842 SEQ ID NO: 23 | 3674 |
| ANTH107 | Heavy chain variable region | monoclonal antibody 10-2 | WO1999055842 SEQ ID NO: 24 | 3675 |
| ANTH108 | Heavy chain variable region | monoclonal antibody 22-1 | WO1999055842 SEQ ID NO: 25 | 3676 |
| ANTH109 | Heavy chain variable region | monoclonal antibody 13-3 | WO1999055842 SEQ ID NO: 26 | 3677 |
| ANTH110 | Heavy chain variable region | monoclonal antibody 8-3 | WO1999055842 SEQ ID NO: 27 | 3678 |
| ANTH111 | Heavy chain variable region | monoclonal antibody 6-1 | WO1999055842 SEQ ID NO 29 | 3679 |
| ANTH112 | Heavy chain variable region | monoclonal antibody 3-1 | WO1999055842 SEQ ID NO: 30 | 3680 |
| ANTH113 | Heavy chain variable region, Edema factor binding | EF12A | US8961975 SEQ ID NO: 51 | 3681 |
| ANTH114 | Heavy chain variable region, Edema factor binding | EF13D | US8961975 SEQ ID NO: 33 | 3682 |
| ANTH115 | Heavy chain variable region, Edema factor binding | EF14H | US8961975 SEQ ID NO: 52 | 3683 |
| ANTH116 | Heavy chain variable region, Edema factor binding | EF15A | US8961975 SEQ ID NO: 53 | 3684 |
| ANTH117 | Heavy chain variable region, Lethal factor | LF9D | US8961975 SEQ ID NO: 49 | 3685 |
| ANTH118 | Heavy chain variable region, Lethal factor | LF10E | US8961975 SEQ ID NO: 1 | 3686 |
| ANTH119 | Heavy chain, Antibody against inhalational anthrax | Obiltoxaximab | | 3687 |
| ANTH120 | Kappa light chain | | US20040258699 SEQ ID NO: 19 | 3688 |
| ANTH121 | Kappa light chain | | US20040258699 SEQ ID NO: 20 | 3689 |
| ANTH122 | Kappa light chain | | US20040258699 SEQ ID NO: 21 | 3690 |
| ANTH123 | Kappa light chain | | US20040258699 SEQ ID NO: 22 | 3691 |
| ANTH124 | Kappa light chain | | US20040258699 SEQ ID NO: 23 | 3692 |
| ANTH125 | Kappa light chain | | US20040258699 SEQ ID NO: 24 | 3693 |
| ANTH126 | Kappa light chain | | US20040258699 SEQ ID NO: 25 | 3694 |

TABLE 15-continued

Antibodies against Anthrax

| Antibody No. | Description | Antibody Name | Reference Information | SEQ ID NO |
|---|---|---|---|---|
| ANTH127 | Kappa light chain | | US20040258699 SEQ ID NO: 26 | 3695 |
| ANTH128 | Kappa light chain | | US20040258699 SEQ ID NO: 39 | 3696 |
| ANTH129 | Kappa light chain | | US20040258699 SEQ ID NO: 40 | 3697 |
| ANTH130 | Kappa light chain | | US20040258699 SEQ ID NO: 41 | 3698 |
| ANTH131 | Kappa light chain | | US20040258699 SEQ ID NO: 42 | 3699 |
| ANTH132 | Kappa light chain | | US20040258699 SEQ ID NO: 43 | 3700 |
| ANTH133 | Kappa light chain | | US20040258699 SEQ ID NO: 44 | 3701 |
| ANTH134 | Kappa light chain | | US20040258699 SEQ ID NO: 45 | 3702 |
| ANTH135 | Kappa light chain | | US20040258699 SEQ ID NO: 46 | 3703 |
| ANTH136 | Kappa light chain | | US20040258699 SEQ ID NO: 47 | 3704 |
| ANTH137 | Kappa light chain | | US20040258699 SEQ ID NO: 48 | 3705 |
| ANTH138 | Kappa light chain | | US20040258699 SEQ ID NO: 49 | 3706 |
| ANTH139 | Kappa light chain | | US20040258699 SEQ ID NO: 50 | 3707 |
| ANTH140 | Kappa light chain | | US20040258699 SEQ ID NO: 51 | 3708 |
| ANTH141 | Kappa light chain | | US20040258699 SEQ ID NO: 52 | 3709 |
| ANTH142 | Kappa light chain | | US20040258699 SEQ ID NO: 53 | 3710 |
| ANTH143 | Kappa light chain | | US20040258699 SEQ ID NO: 54 | 3711 |
| ANTH144 | Kappa light chain | | US20040258699 SEQ ID NO: 55 | 3712 |
| ANTH145 | Kappa light chain | | US20040258699 SEQ ID NO: 56 | 3713 |
| ANTH146 | Kappa light chain | | US20040258699 SEQ ID NO: 57 | 3714 |
| ANTH147 | Kappa light chain | | US20040258699 SEQ ID NO: 58 | 3715 |
| ANTH148 | Kappa light chain | | US20040258699 SEQ ID NO: 59 | 3716 |
| ANTH149 | Kappa light chain | | US20040258699 SEQ ID NO: 60 | 3717 |
| ANTH150 | Kappa light chain | | US20040258699 SEQ ID NO: 61 | 3718 |
| ANTH151 | Lambda light chain | | US20040258699 SEQ ID NO: 27 | 3719 |
| ANTH152 | Lambda light chain | | US20040258699 SEQ ID NO: 28 | 3720 |
| ANTH153 | Lambda light chain | | US20040258699 SEQ ID NO: 29 | 3721 |
| ANTH154 | Lambda light chain | | US20040258699 SEQ ID NO: 30 | 3722 |
| ANTH155 | Lambda light chain | | US20040258699 SEQ ID NO: 31 | 3723 |
| ANTH156 | Lambda light chain | | US20040258699 SEQ ID NO: 32 | 3724 |
| ANTH157 | Lambda light chain | | US20040258699 SEQ ID NO: 33 | 3725 |
| ANTH158 | Lambda light chain | | US20040258699 SEQ ID NO: 34 | 3726 |
| ANTH159 | Lambda light chain | | US20040258699 SEQ ID NO: 35 | 3727 |
| ANTH160 | Lambda light chain | | US20040258699 SEQ ID NO: 36 | 3728 |
| ANTH161 | Lambda light chain | | US20040258699 SEQ ID NO: 37 | 3729 |
| ANTH162 | Lambda light chain | | US20040258699 SEQ ID NO: 38 | 3730 |
| ANTH163 | Lambda light chain | | US20040258699 SEQ ID NO: 62 | 3731 |
| ANTH164 | Lambda light chain | | US20040258699 SEQ ID NO: 63 | 3732 |
| ANTH165 | Lambda light chain | | US20040258699 SEQ ID NO: 64 | 3733 |
| ANTH166 | Lambda light chain | | US20040258699 SEQ ID NO: 65 | 3734 |
| ANTH167 | Lambda light chain | | US20040258699 SEQ ID NO: 66 | 3735 |
| ANTH168 | Lambda light chain | | US20040258699 SEQ ID NO: 67 | 3736 |
| ANTH169 | Lambda light chain | | US20040258699 SEQ ID NO: 68 | 3737 |
| ANTH170 | Lambda light chain | | US20040258699 SEQ ID NO: 69 | 3738 |
| ANTH171 | Lambda light chain | | US20040258699 SEQ ID NO: 70 | 3739 |
| ANTH172 | Lambda light chain | | US20040258699 SEQ ID NO: 71 | 3740 |
| ANTH173 | Lambda light chain | | US20040258699 SEQ ID NO: 72 | 3741 |
| ANTH174 | Lambda light chain | | US20040258699 SEQ ID NO: 73 | 3742 |
| ANTH175 | Lambda light chain | | US20040258699 SEQ ID NO: 74 | 3743 |
| ANTH178 | Lambda light chain | | US20040258699 SEQ ID NO: 75 | 3744 |
| ANTH177 | Lambda light chain | | US20040258699 SEQ ID NO: 76 | 3745 |
| ANTH178 | Lambda light chain | | US20040258699 SEQ ID NO: 77 | 3746 |
| ANTH179 | Light chain | | US8617548 SEQ ID NO: 1 | 3747 |
| ANTH180 | Light chain | IQNPA Lkappa | US7658925 SEQ ID NO: 4 | 3748 |
| ANTH181 | Light chain | IQNPA Lkappa | US7658925 SEQ ID NO: 8 | 3749 |
| ANTH182 | Light chain | 1A5 | US20090022736 SEQ ID NO: 2 | 3750 |
| ANTH183 | Light chain | 4A12 | US20090022736 SEQ ID NO: 4 | 3751 |
| ANTH184 | Light chain | 24B1 | US20090022736 SEQ ID NO: 6 | 3752 |
| ANTH185 | Light chain | 24G4 | US20090022736 SEQ ID NO: 8 | 3753 |
| ANTH186 | Light chain | '32E12 | US20090022736 SEQ ID NO: 10 | 3754 |
| ANTH187 | Light chain | 33F4 | US20090022736 SEQ ID NO: 12 | 3755 |
| ANTH188 | Light chain | scFv 2LF | EP2778173 SEQ ID NO: 6 | 3756 |
| ANTH189 | Light chain | Obiltoxaximab | | 3757 |
| ANTH190 | Light chain region | W1 | US8685396 SEQ ID NO: 9 | 3758 |
| ANTH191 | Light chain region | W2 | US8685396 SEQ ID NO: 25 | 3759 |
| ANTH192 | Light chain region | W5 | USX685396 SEQ ID NO: 37 | 3760 |
| ANTH193 | Light chain region | A63-6 | US8685396 SEQ ID NO: 38 | 3761 |
| ANTH194 | Light chain region | F3-6 | US8685396 SEQ ID NO: 39 | 3762 |
| ANTH195 | Light chain region | F5-1 | US8685396 SEQ ID NO: 40 | 3763 |
| ANTH196 | Light chain variable region | LF11H | US8961975 SEQ ID NO: 25 | 3764 |
| ANTH197 | Light chain variable region | LF9D | US8961975 SEQ ID NO: 17 | 3765 |
| ANTH198 | Light chain variable region | LF10E | US8961975 SEQ ID NO: 9 | 3766 |
| ANTH199 | Light chain variable region | 6.20 | WO2015107307 SEQ ID NO: 2 | 3767 |
| ANTH200 | Light chain variable region | 35PA83 | WO200907186U SEQ ID NO: 2 | 3768 |
| ANTH201 | Light chain variable region | anti-γDPGA | US8501182 SEQ ID NO: 2 | 3769 |

TABLE 15-continued

Antibodies against Anthrax

| Antibody No. | Description | Antibody Name | Reference Information | SEQ ID NO |
|---|---|---|---|---|
| | | antibody | | |
| ANTH202 | Light chain variable region | 4C | US8501182 SEQ ID NO: 4 | 3770 |
| ANTH203 | Light chain variable region | 11D | US8501182 SEQ ID NO: 6 | 3771 |
| ANTH204 | Light chain variable region | F20G75 | WO2007131363 SEQ ID NO: 10 | 3772 |
| ANTH205 | Light chain variable region | F20G76 | WO2007131363 SEQ ID NO: 12 | 3773 |
| ANTH206 | Light chain variable region | F20G77 | WO2007131363 SEQ ID NO: 14 | 3774 |
| ANTH207 | Light chain variable region | V2 variant | US8507655 SEQ ID NO: 8 | 3775 |
| ANTH208 | Light chain variable region | 6.20 variant | US8507655 SEQ ID NO: 10 | 3776 |
| ANTH209 | Light chain variable region | J24.15 variant | US8507655 SEQ ID NO: 12 | 3777 |
| ANTH210 | Light chain variable region | J24.7 variant | US8507655 SEQ ID NO: 14 | 3778 |
| ANTH211 | Light chain variable region | V2 variant human | US8507655 SEQ ID NO: 16 | 3779 |
| ANTH212 | Light chain variable region | 6.20 variant human | US8507655 SEQ ID NO: 18 | 3780 |
| ANTH213 | Light chain variable region | J24.15 variant human | US8507655 SEQ ID NO: 20 | 3781 |
| ANTH214 | Light chain variable region | J24.7 variant human | US8507655 SEQ ID NO: 22 | 3782 |
| ANTH215 | Light chain variable region | HuMab 5E8 (Major) | US8401820 SEQ ID NO: 4 | 3783 |
| ANTH216 | Light chain variable region | HuMab 5E8 (Minor) | US8404820 SEQ ID NO: 6 | 3784 |
| ANTH217 | Light chain variable region | HuMab 2P5 | US8404820 SEQ ID NO: 10 | 3785 |
| ANTH218 | Light chain variable region | HuMab 2H4 | US8404820 SEQ ID NO: 14 | 3786 |
| ANTH219 | Light chain variable region | HuMab 5D5-2E10 | US8404820 SEQ ID NO: 18 | 3787 |
| ANTH220 | Light chain variable region | 13E3 | US8309090 SEQ ID NO: 4 | 3788 |
| ANTH221 | Light chain variable region | 3E1 | US8309090 SEQ ID NO: 8 | 3789 |
| ANTH222 | Light chain variable region | KCTC 10756BP | US8268316 SEQ ID NO: 7 | 3790 |
| ANTH223 | Light chain variable region | modified M18 sequence | US7902344; US6916474 SEQ ID NO: 25 | 3791 |
| ANTH224 | Light chain variable region | 21D9 MAb | US7442373 SEQ ID NO: 4 | 3792 |
| ANTH225 | Light chain variable region | 1C6 Mab | US7442373 SEQ ID NO: 8 | 3793 |
| ANTH226 | Light chain variable region | 4H7 Mab | US7442373 SEQ ID NO: 12 | 3794 |
| ANTH227 | Light chain variable region | 22G12 Mab | US7442373 SEQ ID NO: 16 | 3795 |
| ANTH228 | Light chain variable region antibody against anthrax toxin, | ETI-204 | US20120156196 SEQ ID NO: 2 | 3796 |
| ANTH229 | Light chain variable region, Edema factor | EF12A | US8961975 SEQ ID NO: 54 | 3797 |
| ANTH230 | Light chain variable region, Edema factor | EF13D | US8961975 SEQ ID NO: 41 | 3798 |
| ANTH231 | Light chain variable region, Edema factor | EF14H | US8961973 SEQ ID NO: 55 | 3799 |
| ANTH232 | Light chain variable region, Edema factor | EP15A | US8961975 SEQ ID NO: 56 | 3800 |
| ANTH233 | Scfv | PWB2447 scFv | US7601351; US7906119; US20110189197 SEQ ID NO 48 | 3801 |
| ANTH234 | Scfv | PWC2004 scFv | US7601351; US7906119; US20110189197 SEQ ID NO: 49 | 3802 |
| ANTH235 | Scfv | PWD0283 scFv | US7601351; US7906119; US20110189197 SEQ ID NO 50 | 3803 |
| ANTH236 | Scfv | PWP0323 scFv | US7601351; US7906119; US20110189197 SEQ ID NO: 51 | 3804 |
| ANTH237 | Scfv | PWD0422 scFv | US7601351; US7906119; US20110189197 SEQ ID NO: 52 | 3805 |
| ANTH238 | Scfv | PWD0587 scFv | US7601351; US7906119; US20110189197 SEQ ID NO: 53 | 3806 |
| ANTH239 | Scfv | PWD0791 scFv | US7601351; US7906119; US20110189197 SEQ ID NO: 54 | 3807 |
| ANTH240 | Scfv | PHP2222 scFv | US7601351; US7906119; US20110189197 SEQ ID NO: 55 | 3808 |
| ANTH241 | Scfv | PHD2581 scFv | US7601351; US7906119; US20110189197 SEQ ID NO: 56 | 3809 |
| ANTH242 | | Abthrax | US20120136196 SEQ ID NO: 48 | 3810 |
| ANTH243 | | Abthrax | US20120156196 SEQ ID NO: 49 | 3811 |
| ANTH244 | | | WO2003063768 SEQ ID NO: 4 | 3812 |
| ANTH245 | | | WO2003063768 SEQ ID NO: 5 | 3813 |

In one embodiment, the payload region of the AAV particle comprises one or more nucleic acid sequences encoding one or more of the payload antibody polypeptides listed in Table 16 against Botulinum Toxin.

TABLE 16

Antibodies against Botulinum Toxin

| Antibody No. | Description | Antibody Name | Reference Information | SEQ ID NO |
|---|---|---|---|---|
| BOTT1 | Heavy-chain-only | | US20130058962 SEQ ID NO: 56 | 3814 |
| BOTT2 | Heavy-chain-only | | US20130058962 SEQ ID NO: 57 | 3815 |
| BOTT3 | Heavy-chain-only | | US20130058962 SEQ ID NO: 58 | 3816 |
| BOTT4 | Heavy-chain only binding agents specific to BoNT/A holotoxin | JDA-D12 | WO2015100409 SEQ ID NO: 20 | 3817 |
| BOTT5 | Heavy-chain only binding agents specific to BoNT/A holotoxin | JDQ-A5 | WO2015100409 SEQ ID NO: 22 | 3818 |
| BOTT6 | Heavy-chain only binding agents specific to BoNT/A holotoxin | JDQ-B5 | WO2015100409 SEQ ID NO: 24 | 3819 |
| BOTT7 | Heavy-chain only binding agents specific to BoNT/A holotoxin | JDQ-C2 | WO2015100409 SEQ ID NO: 26 | 3820 |
| BOTT8 | Heavy-chain only binding agents specific to BoNT/A holotoxin | JDQ-F 12 | WO2015100409 SEQ ID NO: 28 | 3821 |
| BOTT9 | Heavy-chain only binding agents specific to BoNT/A holotoxin | JDQ-G5 | WO2015100409 SEQ ID NO: 30 | 3822 |
| BOTT10 | Heavy-chain only binding agents specific to BoNT/A holotoxin | JDQ-H7 | WO2015100409 SEQ ID NO: 32 | 3823 |
| BOTT11 | Heavy-chain only binding agents specific to BoNT/A holotoxin | JEQ-A5 | WO2015100409 SEQ ID NO: 34 | 3824 |
| BOTT12 | Heavy-chain only binding agents specific to BoNT/A holotoxin | JEQ-H11 | WO2015100409 SEQ ID NO: 36 | 3825 |
| BOTT13 | Heavy-chain only binding agent | E-9 | WO2015100409 SEQ ID NO: 38 | 3826 |
| BOTT14 | Heavy-chain only binding agent | B2 | WO2015100409 SEQ ID NO: 40 | 3827 |
| BOTT15 | Heavy-chain only binding agent | C5 | WO2015100409 SEQ ID NO: 42 | 3828 |
| BOTT16 | Heavy-chain only binding agent | F9 | WO2015100409 SEQ ID NO: 44 | 3829 |
| BOTT17 | Heavy-chain only binding agent | heavy-chain only binding agent | WO2015100409 SEQ ID NO: 46 | 3830 |
| BOTT18 | Heavy-chain only binding agent with tag | heavy-chain only binding agent with tag | WO2015100409 SEQ ID NO: 48 | 3831 |
| BOTT19 | Heavy-chain only binding agent with tag | heavy-chain only binding agent with tag | WO2015100409 SEQ ID NO: 50 | 3832 |
| BOTT20 | Heavy-chain only dimer binding agent with two tags | heavy-chain only dimer binding agent with two tags | WO2015100409 SEQ ID NO: 52 | 3833 |
| BOTT21 | Recombinant camelid heavy-chain-only antibody | H7 | WO2015100409 SEQ ID NO: 56 | 3834 |
| BOTT22 | Recombinant camelid heavy-chain-only antibody | B5 | WO2015100409 SEQ ID NO: 57 | 3835 |
| BOTT23 | Recombinant camelid heavy-chain-only antibody | | WO2015100409 SEQ ID NO: 58 | 3836 |
| BOTT24 | Scfv | scFv#2 | WO2015100409 SEQ ID NO: 2 | 3837 |
| BOTT25 | Scfv | scFv#3 | WO2015100409 SEQ ID NO: 4 | 3838 |
| BOTT26 | Scfv | scFv#7 | WO2015100409 SEQ ID NO: 6 | 3839 |
| BOTT27 | Scfv | scFv#8 | WO2015100409 SEQ ID NO: 8 | 3840 |
| BOTT28 | Scfv | scFv#21 | WO2015100409 SEQ ID NO: 10 | 3841 |
| BOTT29 | Scfv | scFv#E | WO2015100409 SEQ ID NO: 12 | 3842 |
| BOTT30 | Scfv | scFv#7-2E | WO2015100409 SEQ ID NO: 14 | 3843 |

In one embodiment, the payload region of the AAV particle comprises one or more nucleic acid sequences encoding one or more of the payload antibody polypeptides listed in Table 17 against Shiga Toxin.

TABLE 17

| Antibodies against Shiga Toxin | | | | |
|---|---|---|---|---|
| Antibody No. | Description | Antibody Name | Reference Information | SEQ ID NO |
| SHIG1 | Camelid heavy-chain only | JET-H12 | WO2015100409 SEQ ID NO: 96 | 3844 |
| SHIG2 | Camelid heavy-chain only | JFG-H6 | WO2015100409 SEQ ID NO: 98 | 3845 |
| SHIG3 | Heavy chain | | US2014013548 SEQ ID NO: 44 | 3846 |
| SHIG4 | Heavy chain | | US2014013548 SEQ ID NO: 21 | 3847 |
| SHIG5 | Heavy chain of cαstx1 | Shigamab | US20120195891 SEQ ID NO: 1 | 3848 |
| SHIG6 | Heavy chain of cαstx1 | Shigamab | US20120195891 SEQ ID NO: 2 | 3849 |
| SHIG7 | Heavy chain of cαstx2 | Shigamab | US20120195891 SEQ ID NO: 3 | 3850 |
| SHIG8 | Heavy chain of cαstx2 | Shigamab | US20120195891 SEQ ID NO: 4 | 3851 |
| SHIG9 | Heavy chain single domain | | WO2014191904 SEQ ID NO: 7 | 3852 |
| SHIG10 | Heavy chain single domain | | WO2014191904 SEQ ID NO: 8 | 3853 |
| SHIG11 | Heavy chain single domain | | WO2014191904 SEQ ID NO: 9 | 3854 |
| SHIG12 | Heavy chain single domain | | WO2014191904 SEQ ID NO: 10 | 3855 |
| SHIG13 | Heavy chain single domain | | WO2014191904 SEQ ID NO: 11 | 3856 |
| SHIG14 | Heavy chain single domain | | WO2014191904 SEQ ID NO: 12 | 3857 |
| SHIG15 | Heavy chain single domain | | WO2014191904 SEQ ID NO: 13 | 3858 |
| SHIG16 | Heavy chain single domain | | WO2014191904 SEQ ID NO: 14 | 3859 |
| SHIG17 | Heavy chain single domain | | WO2014191904 SEQ ID NO: 15 | 3860 |
| SHIG18 | Heavy chain single domain | | WO2014191904 SEQ ID NO: 16 | 3861 |
| SHIG19 | Heavy chain single domain | | WO2014191904 SEQ ID NO: 17 | 3862 |
| SHIG20 | Heavy chain single domain | | WO2014191904 SEQ ID NO: 18 | 3863 |
| SHIG21 | Heavy chain single domain | | WO2014191904 SEQ ID NO: 19 | 3864 |
| SHIG22 | Heavy chain single domain | | WO2014191904 SEQ ID NO: 20 | 3865 |
| SHIG23 | Heavy chain single domain | | WO2014191904 SEQ ID NO: 21 | 3866 |
| SHIG24 | Heavy chain single domain | | WO2014191904 SEQ ID NO: 22 | 3867 |
| SHIG25 | Heavy chain single domain | | WO2014191904 SEQ ID NO: 23 | 3868 |
| SHIG26 | Heavy chain single domain | | WO2014191904 SEQ ID NO: 24 | 3869 |
| SHIG27 | Heavy chain single domain | | WO2014191904 SEQ ID NO: 25 | 3870 |
| SHIG28 | Heavy chain single domain | | WO2014191904 SEQ ID NO: 26 | 3871 |
| SHIG29 | Heavy chain single domain | | WO2014191904 SEQ ID NO: 27 | 3872 |
| SHIG30 | Heavy chain single domain | | WO2014191904 SEQ ID NO: 28 | 3873 |
| SHIG31 | Heavy chain single domain | | WO2014191904 SEQ ID NO: 29 | 3874 |
| SHIG32 | Heavy chain single domain | | WO2014191904 SEQ ID NO: 30 | 3875 |
| SHIG33 | Heavy chain single domain | | WO2014191904 SEQ ID NO: 31 | 3876 |
| SHIG34 | Heavy chain single domain | | WO2014191904 SEQ ID NO: 32 | 3877 |
| SHIG35 | Heavy chain single domain | | WO2014191904 SEQ ID NO: 33 | 3878 |
| SHIG36 | Heavy chain single domain | | WO2014191904 SEQ ID NO: 34 | 3879 |
| SHIG37 | Heavy chain single domain | | WO2014191904 SEQ ID NO: 35 | 3880 |
| SHIG38 | Heavy chain single domain | | WO2014191904 SEQ ID NO: 36 | 3881 |
| SHIG39 | Heavy chain single domain | | WO2014191904 SEQ ID NO: 37 | 3882 |
| SHIG40 | Heavy chain single domain | | WO2014191904 SEQ ID NO: 38 | 3883 |
| SHIG41 | Heavy chain single domain | | WO2014191904 SEQ ID NO: 39 | 3884 |
| SHIG42 | Heavy chain single domain | | WO2014191904 SEQ ID NO: 40 | 3885 |
| SHIG43 | Heavy chain single domain | | WO2014191904 SEQ ID NO: 41 | 3886 |
| SHIG44 | Heavy chain single domain | | WO2014191904 SEQ ID NO: 42 | 3887 |
| SHIG45 | Heavy chain single domain | | WO2014191904 SEQ ID NO: 43 | 3888 |
| SHIG46 | Heavy chain single domain | | WO2014191904 SEQ ID NO: 44 | 3889 |
| SHIG47 | Heavy chain single domain | | WO2014191904 SEQ ID NO: 45 | 3890 |
| SHIG48 | Heavy chain single domain | | WO2014191904 SEQ ID NO: 46 | 3891 |
| SHIG49 | Heavy chain single domain | | WO2014191904 SEQ ID NO: 47 | 3892 |
| SHIG50 | Heavy-chain-only | | US20130058962 SEQ ID NO: 77 | 3893 |
| SHIG51 | Heavy-chain-only | | US20130058962 SEQ ID NO: 78 | 3894 |
| SHIG52 | Heavy-chain-only | | US20130058962 SEQ ID NO: 79 | 3895 |
| SHIG53 | Heavy-chain-only | | US20130058962 SEQ ID NO: 80 | 3896 |
| SHIG54 | Heavy-chain-only | | US20130058962 SEQ ID NO: 81 | 3897 |
| SHIG55 | Heavy-chain-only | | US20130058962 SEQ ID NO: 82 | 3898 |
| SHIG56 | Heavy-chain-only | | US20130058962 SEQ ID NO: 83 | 3899 |
| SHIG57 | Heavy-chain-only | | US20130058962 SEQ ID NO: 84 | 3900 |
| SHIG58 | Heavy-chain-only | | US20130058962 SEQ ID NO: 85 | 3901 |
| SHIG59 | Heavy-chain-only | | US20130058962 SEQ ID NO: 86 | 3902 |
| SHIG60 | Light chain | | US2014013548 SEQ ID NO: 42 | 3903 |
| SHIG61 | Light chain | | US2014013548 SEQ ID NO: 19 | 3904 |
| SHIG62 | Recombinant camelid heavy-chain-only antibody, STX1 | JET-A9 | WO2015100409 SEQ ID NO: 77 | 3905 |
| SHIG63 | Recombinant camelid heavy-chain-only antibody, STX1 | JGG-D4 | WO2015100409 SEQ ID NO: 78 | 3906 |
| SHIG64 | Recombinant camelid heavy-chain-only antibody, STX1, STX2 | JFD-A4 | WO2015100409 SEQ ID NO: 84 | 3907 |
| SHIG65 | Recombinant camelid heavy-chain-only antibody, STX1, STX2 | JFD-A5 | WO2015100409 SEQ ID NO: 85 | 3908 |
| SHIG66 | Recombinant camelid heavy-chain-only antibody, STX1, STX2 | JGG-G6 | WO2015100409 SEQ ID NO: 86 | 3909 |

TABLE 17-continued

Antibodies against Shiga Toxin

| Antibody No. | Description | Antibody Name | Reference Information | SEQ ID NO |
|---|---|---|---|---|
| SHIG67 | Recombinant camelid heavy-chain-only antibody, STX2 | JEN-D10 | WO2015100409 SEQ ID NO: 79 | 3910 |
| SHIG68 | Recombinant camelid heavy-chain-only antibody, STX2 | JGH-G1 | WO2015100409 SEQ ID NO: 80 | 3911 |
| SHIG69 | Recombinant camelid heavy-chain-only antibody, STX2 | JEU-A6 | WO2015100409 SEQ ID NO: 81 | 3912 |
| SHIG70 | Recombinant camelid heavy-chain-only antibody, STX2 | JEU-D2 | WO2015100409 SEQ ID NO: 82 | 3913 |
| SHIG71 | Recombinant camelid heavy-chain-only antibody, STX2 | JGH-G9 | WO2015100409 SEQ ID NO: 83 | 3914 |

In one embodiment, the payload region of the AAV particle comprises one or more nucleic acid sequences, fragment or variants thereof or encodes one or more polypeptides, fragments or variants thereof described in US Pub. No. US20090280104, the contents of each of which are herein incorporated by reference in their entirety, against Shiga toxin Tropical Diseases In one embodiment, the payload region of the AAV particle comprises one or more nucleic acid sequences encoding one or more of the tropical disease related payload antibody polypeptides listed in Tables 18-20.

In one embodiment, the payload region of the AAV particle comprises one or more nucleic acid sequences encoding one or more of the payload antibody polypeptides listed in Table 18 against *Plasmodium falciparum* causing Malaria.

TABLE 18

Antibodies against *Plasmodium Falciparum* causing Malaria

| Antibody No. | Description | Antibody Name | Reference Information | SEQ ID NO |
|---|---|---|---|---|
| MALA1 | Heavy chain | immunoglobulin heavy chain variable region, partial | Wajanarogana, S. et al., Construction of a human functional single-chain variable fragment (scFv) antibody recognizing the malaria parasite *Plasmodium falciparum*, Biotechnol. Appl. Biochem. 44 (PT 1), 55-61 (2006), NCBI Accession # AAX76832.1 (129aa) | 3915 |
| MALA2 | Heavy chain | anti-MSP1 MAD20 block2 ScFv Ig heavy chain variable region, partial | Sowa, K. M. et al., Isolation of a monoclonal antibody from a malaria patient-derived phage display library recognizing the Block 2 region of *Plasmodium falciparum* merozoite surface protein-1, Mol. Biochem. Parasitol. 112 (1), 143-147 (2001), NCBI Accession #AAK08696.1 (119aa) | 3916 |
| MALA3 | Heavy chain | immunoglobulin heavy chain variable region, partial | Lundquist, R. et al., Human recombinant antibodies against *Plasmodium falciparum* merozoite surface protein 3 cloned from peripheral blood leukocytes of individuals with immunity to malaria demonstrate antiparasitic properties, Infect. Immun. 74 (6), 3222-3231, (2006), NCBI Accession # AAT09786.1 (113aa) | 3917 |
| MALA4 | Heavy chain variable region | 2A10 anti-malaria antibody | NCBI Accession # BAK41504.1 (118aa) | 3918 |
| MALA5 | Heavy chain | | U.S. Pat. No. 7,811,569 to Dziegiel; SEQ ID NO: 1 | 3919 |
| MALA6 | Heavy chain, Anti-ang-2 antibody | | U.S. Pat. No. 7,811,569 to Dziegiel; SEQ ID NO: 3 | 3920 |
| MALA7 | Heavy chain | | U.S. Pat. No. 7,811,569 to Dziegiel; SEQ ID NO: 5 | 3921 |
| MALA8 | Heavy chain variable region | | US20150197562 SEQ ID NO: 14 | 3922 |
| MALA9 | Heavy chain variable region | mAh 5D5 | US20150158941 SEQ ID NO: 16 | 3923 |
| MALA10 | Heavy chain variable region | | US20140112930 SEQ ID NO: 18 | 3924 |
| MALA11 | Heavy chain variable region | M071Xi0199 | WO2014087007; SEQ ID NO: 182 | 3925 |
| MALA12 | Heavy chain variable region | M071Xi2204 | WO2014087007; SEQ ID NO: 186 | 3926 |

TABLE 18-continued

Antibodies against *Plasmodium Falciparum* causing Malaria

| Antibody No. | Description | Antibody Name | Reference Information | SEQ ID NO |
|---|---|---|---|---|
| MALA13 | Heavy chain variable region | M071Xi0237 | WO2014087007; SEQ ID NO: 190 | 3927 |
| MALA14 | Heavy chain variable region | M071Xi2127 | WO2014087007; SEQ ID NO: 194 | 3928 |
| MALA15 | Heavy chain variable region | M071Xi0092 | WO2014087007; SEQ ID NO: 198 | 3929 |
| MALA16 | Heavy chain variable region | M071Xi2057 | WO2014087007; SEQ ID NO: 202 | 3930 |
| MALA17 | Heavy chain variable region | M070Xi3010 | WO2014087007; SEQ ID NO: 206 | 3931 |
| MALA18 | Heavy chain variable region | M071Xi0227 | WO2014087007; SEQ ID NO: 210 | 3932 |
| MALA19 | Heavy chain variable region | M071Xi0081 | WO2014087007; SEQ ID NO: 214 | 3933 |
| MALA20 | Heavy chain variable region | M071Xi0124 | WO2014087007; SEQ ID NO: 218 | 3934 |
| MALA21 | Heavy chain variable region | M036Xi0326 | WO2014087007; SEQ ID NO: 222 | 3935 |
| MALA22 | Heavy chain variable region | M070Xi3195 | WO2014087007; SEQ ID NO: 226 | 3936 |
| MALA23 | Heavy chain variable region | M070Xi3062 | WO2014087007; SEQ ID NO: 230 | 3937 |
| MALA24 | Heavy chain variable region | M071Xi2217 | WO2014087007; SEQ ID NO: 234 | 3938 |
| MALA25 | Heavy chain variable region | M036Xi0003 | WO2014087007; SEQ ID NO: 238 | 3939 |
| MALA26 | Heavy chain, Eba-175 | R217 | Chen et al., PLoS Pathol. 9 (5), E1003390 (2013), NCBI Accession # 4QEX_I (215aa) | 3940 |
| MALA27 | Heavy chain, Eba-175 | R218 | Chen et al., PLoS Pathol. 9 (5), E1003390 (2013), NCBI Accession # 4K2U_I (233aa) | 3941 |
| MALA28 | Light chain | anti-MSP1 MAD20 block2 ScFv Ig heavy chain variable region, partial | Sowa, K. M. et al., Isolation of a monoclonal antibody from a malaria patient-derived phage display library recognizing the Block 2 region of *Plasmodium falciparum* merozoite surface protein-1, Mol. Biochem. Parasitol. 112 (1), 143-147 (2001), NCBI Accession #AAK08697.1 (119aa) | 3942 |
| MALA29 | Light chain | anti-MSP1 MAD20 block2 ScFv Ig light chain variable region, partial | Sowa, K. M. et al., Isolation of a monoclonal antibody from a malaria patient-derived phage display library recognizing the Block 2 region of *Plasmodium falciparum* merozoite surface protein-1, Mol. Biochem. Parasitol. 112 (1), 143-147 (2001), NCBI Accession #AAK08698.1 (110aa) | 3943 |
| MALA30 | Light chain | immunoglobulin light chain variable region, partial | Wajanarogana, S. et al., Construction of a human functional single-chain variable fragment (scFv) antibody recognizing the malaria parasite *Plasmodium falciparum*, Biotechnol. Appl. Biochem. 44 (PT 1), 55-61 (2006) AAX76833.1 (107aa) | 3944 |
| MALA31 | Kappa light chain | immunoglobulin kappa light chain variable region, partial | Lundquist, R. et al., Human recombinant antibodies against *Plasmodium falciparum* merozoite surface protein 3 cloned from peripheral blood leukocytes of individuals with immunity to malaria demonstrate antiparasitic properties, Infect. Immun. 74 (6), 3222-3231, (2006), NCBI Accession # AAT09787.1 (113aa) | 3945 |
| MALA32 | Light chain variable region | 2A10 anti-malaria antibody | NCBI Accession # BAK41503.1 (108aa) | 3946 |
| MALA33 | Light chain | | U.S. Pat. No. 7,811,569 to Dziegiel; SEQ ID NO: 2 | 3947 |
| MALA34 | Light chain, Anti-ang-2 antibody | | U.S. Pat. No. 7,811,569 to Dziegiel; SEQ ID NO: 4 | 3948 |
| MALA35 | Light chain | | U.S. Pat. No. 7,811,569 to Dziegiel; SEQ ID NO: 6 | 3949 |
| MALA36 | Light chain variable region | | US20150197562 SEQ ID NO: 15 | 3950 |
| MALA37 | Light chain variable region | | US20150197562 SEQ ID NO: 19 | 3951 |
| MALA38 | Light chain variable region | mAb 5D5 | US20150158941 SEQ ID NO: 14 | 3952 |
| MALA39 | Light chain variable region | | US20140112930 SEQ ID NO: 20 | 3953 |

TABLE 18-continued

Antibodies against Plasmodium Falciparum causing Malaria

| Antibody No. | Description | Antibody Name | Reference Information | SEQ ID NO |
|---|---|---|---|---|
| MALA40 | Light chain variable region | M071Xi0199 | WO2014087007; SEQ ID NO: 184 | 3954 |
| MALA41 | Light chain variable region | M071Xi2204 | WO2014087007; SEQ ID NO: 188 | 3955 |
| MALA42 | Light chain variable region | M071Xi0237 | WO2014087007; SEQ ID NO: 192 | 3956 |
| MALA43 | Light chain variable region | M071Xi2127 | WO2014087007; SEQ ID NO: 196 | 3957 |
| MALA44 | Light chain variable region | M071Xi0092 | WO2014087007; SEQ ID NO: 200 | 3958 |
| MALA45 | Light chain variable region | M071Xi2057 | WO2014087007; SEQ ID NO: 204 | 3959 |
| MALA46 | Light chain variable region | M070Xi3010 | WO2014087007; SEQ ID NO: 208 | 3960 |
| MALA47 | Light chain variable region | M071Xi0227 | WO2014087007; SEQ ID NO: 212 | 3961 |
| MALA48 | Light chain variable region | M071Xi0081 | WO2014087007; SEQ ID NO: 216 | 3962 |
| MALA49 | Light chain variable region | M071Xi0124 | WO2014087007; SEQ ID NO: 220 | 3963 |
| MALA50 | Light chain variable region | M036Xi0326 | WO2014087007; SEQ ID NO: 224 | 3964 |
| MALA51 | Light chain variable region | M070Xi3195 | WO2014087007; SEQ ID NO: 228 | 3965 |
| MALA52 | Light chain variable region | M070Xi3062 | WO2014087007; SEQ ID NO: 232 | 3966 |
| MALA53 | Light chain variable region | M071Xi2217 | WO2014087007; SEQ ID NO: 236 | 3967 |
| MALA54 | Light chain variable region | M036Xi0003 | WO2014087007; SEQ ID NO: 240 | 3968 |
| MALA55 | Light chain, Eba-175 | R217 | Chen et al., PLoS Pathol. 9 (5), E1003390 (2013), NCBI Accession # 4QEX_M (214aa) | 3969 |
| MALA56 | Light chain, Eba-175 | R218 | Chen et al., PLoS Pathol. 9 (5), E1003390 (2013), NCBI Accession # 4K2U_M (234aa) | 3970 |
| MALA57 | Vivax apical membrane antigen 1 monoclonal antibody, seqres | F8.12.19 | NCBI Accession # 2J4W_L (213aa) | 3971 |

In one embodiment, the payload region of the AAV particle comprises one or more nucleic acid sequences encoding one or more of the payload antibody polypeptides listed in Table 19 against Ebola and/or Margburg Viruses.

TABLE 19

Antibodies against Ebola and Marburg viruses

| Antibody No. | Description | Antibody Name | Reference Information | SEQ ID NO |
|---|---|---|---|---|
| EBOL1 | Chain A, Sudan Ebolavirus Glycoprotein (Strain Boniface) | 16f6 | Bale et al., Structural basis for differential neutralization of ebolaviruses; Viruses 4 (4), 447-470 (2012), NCBI Accession # 3VE0_B (212aa) | 3972 |
| EBOL2 | Chain B, Sudan Ebolavirus Glycoprotein (Strain Boniface) | 16f6 | Bale et al., Structural basis for differential neutralization of ebolaviruses; Viruses 4 (4), 447-470 (2012), NCBI Accession # 3VE0_A (220aa) | 3973 |
| EBOL3 | Ebola Virus Glycoprotein | 13f6-1-2 Fab | Lee J. E. et al., Complex of a protective antibody with its Ebola virus GP peptide epitope: unusual features of a V lambda x light chain; J. Mol. Biol. 375 (1), 202-216 (2008), NCBI Accession # 2QHR_L (218aa) | 3974 |
| EBOL4 | Ebola Virus Glycoprotein | 13f6-1-2 Fab | Lee J. E. et al., Complex of a protective antibody with its Ebola virus GP peptide epitope: unusual features of a V lambda x light chain; J. Mol. Biol. 375 | 3975 |

TABLE 19-continued

Antibodies against Ebola and Marburg viruses

| Antibody No. | Description | Antibody Name | Reference Information | SEQ ID NO |
|---|---|---|---|---|
| | | | (1), 202-216 (2008), NCBI Accession # 2QHR_H (222aa) | |
| EBOL5 | Fab heavy chain Envelope Glycoprotein Gp1 | Mr78 | Hashiguchi, T., et al., Cell 160 (5), 904-912 (2015), NCBI Accession # 3X2D_P (226aa) | 3976 |
| EBOL6 | Fab light chain, Envelope Glycoprotein Gp1 | Mr78 | Hashiguchi, T., et al., Cell 160 (5), 904-912 (2015), NCBI Accession # 3X2D_O (213aa) | 3977 |
| EBOL7 | Fusion protein, Zaire Ebola virus, Mayinga strain glycoprotein | | US20140356354 SEQ ID NO: 2 | 3978 |
| EBOL8 | Heavy chain Ebolavirus-Protective Antibody | | Olal, D., et al., Structure of an Antibody in Complex with Its Mucin Domain Linear Epitope That Is Protective against Ebola Virus; J. Virol. 86 (5), 2809-2816 (2012), NCBI Accession # 2Y6S_H (213aa) | 3979 |
| EBOL9 | Heavy chain Filovirus (Ebola or Marburg) | | US20140356354 SEQ ID NO: 6 | 3980 |
| EBOL10 | Heavy chain Filovirus (Ebola or Marburg) | | US20140356354 SEQ ID NO: 7 | 3981 |
| EBOL11 | Heavy chain Filovirus (Ebola or Marburg) | | US20140356354 SEQ ID NO: 8 | 3982 |
| EBOL12 | Heavy chain Filovirus (Ebola or Marburg) | | US20140356354 SEQ ID NO: 9 | 3983 |
| EBOL13 | Heavy chain Filovirus (Ebola or Marburg) | | US20140356354 SEQ ID NO: 10 | 3984 |
| EBOL14 | Heavy chain Filovirus (Ebola or Marburg) | | US20140356354 SEQ ID NO: 11 | 3985 |
| EBOL15 | Heavy chain variable region, Zaire ebolavirus (ZEBOV) glycoprotein | | WO2015127136 SEQ ID NO: 71 | 3986 |
| EBOL16 | Heavy chain variable region, Zaire ebolavirus (ZEBOV) glycoprotein | | WO2015127136 SEQ ID NO: 47 | 3987 |
| EBOL17 | Heavy chain variable region, Zaire ebolavirus (ZEBOV) glycoprotein | | WO2015127136 SEQ ID NO: 23 | 3988 |
| EBOL18 | Heavy chain variable region, Ebola Sudan Boniface virus (ESB) glycoprotein (GP) | 16H11 | U.S. Pat. No. 9,097,713 SEQ ID NO: 2 | 3989 |
| EBOL19 | Heavy chain variable region, Ebola Sudan Boniface virus (ESB) glycoprotein (GP) | 19B3 | U.S. Pat. No. 9,097,713 SEQ ID NO: 4 | 3990 |
| EBOL20 | Heavy chain variable region, Ebola Sudan Boniface virus (ESB) glycoprotein (GP) | 17F6 | U.S. Pat. No. 9,097,713 SEQ ID NO: 6 | 3991 |
| EBOL21 | Heavy chain variable region, Ebola Sudan Boniface virus (ESB) glycoprotein (GP) | 16F6 | U.S. Pat. No. 9,097,713 SEQ ID NO: 8 | 3992 |
| EBOL22 | Heavy chain variable region, Ebola virus GP | EGP 6D8 1-2 | U.S. Pat. No. 7,335,356 SEQ ID NO: 22 | 3993 |
| EBOL23 | Heavy chain variable region, Ebola virus GP | EGP13F6-1-2 | U.S. Pat. No. 7,335,356 SEQ ID NO: 32 | 3994 |
| EBOL24 | Heavy chain variable region, Ebola virus GP | EGP13C6-1-1 | U.S. Pat. No. 7,335,356 SEQ ID NO: 12 | 3995 |
| EBOL25 | Heavy chain variable region, Marburg virus, Ebola virus, Sudan virus, Bundibugyo virus, Tai Forest virus or Reston virus glycoprotein | | WO2015127140 SEQ ID NO: 14 | 3996 |
| EBOL26 | Heavy chain variable region, Marburg virus, Ebola virus, Sudan virus, Bundibugyo virus, Tai Forest virus or Reston virus glycoprotein | | WO2015127140 SEQ ID NO: 38 | 3997 |
| EBOL27 | Heavy chain variable region, Marburg virus, Ebola virus, Sudan virus, Bundibugyo virus, Tai Forest virus or Reston virus glycoprotein | | WO2015127140 SEQ ID NO: 62 | 3998 |
| EBOL28 | Heavy chain variable region, Marburg virus, Ebola virus, Sudan virus, Bundibugyo virus, Tai Forest virus or Reston virus glycoprotein | | WO2015127140 SEQ ID NO: 86 | 3999 |
| EBOL29 | Heavy chain variable region, Marburg virus, Ebola virus, Sudan | | WO2015127140 SEQ ID NO: 110 | 4000 |

TABLE 19-continued

Antibodies against Ebola and Marburg viruses

| Antibody No. | Description | Antibody Name | Reference Information | SEQ ID NO |
|---|---|---|---|---|
| | virus, Bundibugyo virus, Tai Forest virus or Reston virus glycoprotein | | | |
| EBOL30 | Heavy chain variable region, Marburg virus, Ebola virus, Sudan virus, Bundibugyo virus, Tai Forest virus or Reston virus glycoprotein | | WO2015127140 SEQ ID NO: 134 | 4001 |
| EBOL31 | Heavy chain variable region, Marburg virus, Ebola virus, Sudan virus, Bundibugyo virus, Tai Forest virus or Reston virus glycoprotein | | WO2015127140 SEQ ID NO: 158 | 4002 |
| EBOL32 | Heavy chain, Ebola virus glycoprotein, | Fab Kz52 | Lee J. E. et al., Structure of the Ebola virus glycoprotein bound to an antibody from a human survivor; Nature 454 (7201), 177-182 (2008), NCBI Accession # 3CSY_G (226aa) | 4003 |
| EBOL33 | Light chain variable region, Ebola Sudan Boniface virus (ESB) glycoprotein (GP) | 16F6 | U.S. Pat. No. 9,097,713 SEQ ID NO: 10 | 4004 |
| EBOL34 | Light chain variable region, Ebola virus GP | EGP 6D8 1-2 | U.S. Pat. No. 7,335,356 SEQ ID NO: 27 | 4005 |
| EBOL35 | Light chain variable region, Ebola virus GP | EGP13F6-1-2 | U.S. Pat. No. 7,335,356 SEQ ID NO: 37 | 4006 |
| EBOL36 | Light chain variable region, Ebola virus GP | EGP13C6-1-1 | U.S. Pat. No. 7,335,356 SEQ ID NO: 16 | 4007 |
| EBOL37 | Light chain variable region, Marburg virus, Ebola virus, Sudan virus, Bundibugyo virus, Tai Forest virus or Reston virus glycoprotein | | WO2015127140 SEQ ID NO: 2 | 4008 |
| EBOL38 | Light chain variable region, Marburg virus, Ebola virus, Sudan virus, Bundibugyo virus, Tai Forest virus or Reston virus glycoprotein | | WO2015127140 SEQ ID NO: 26 | 4009 |
| EBOL39 | Light chain variable region, Marburg virus, Ebola virus, Sudan virus, Bundibugyo virus, Tai Forest vires or Reston virus glycoprotein | | WO2015127140 SEQ ID NO: 50 | 4010 |
| EBOL40 | Light chain variable region, Marburg virus, Ebola virus, Sudan virus, Bundibugyo virus, Tai Forest virus or Reston virus glycoprotein | | WO2015127140 SEQ ID NO: 74 | 4011 |
| EBOL41 | Light chain variable region, Marburg virus, Ebola virus, Sudan virus, Bundibugyo virus, Tai Forest virus or Reston virus glycoprotein | | WO2015127140 SEQ ID NO: 98 | 4012 |
| EBOL42 | Light chain variable region, Marburg virus, Ebola virus, Sudan virus, Bundibugyo virus, Tai Forest virus or Reston virus glycoprotein | | WO2015127140 SEQ ID NO: 122 | 4013 |
| EBOL43 | Light chain variable region, Marburg virus, Ebola virus, Sudan virus, Bundibugyo virus, Tai Forest virus or Reston virus glycoprotein | | WO2015127140 SEQ ID NO: 146 | 4014 |
| EBOL44 | Light chain variable region, Zaire ebolavirus (ZEBOV) glycoprotein | | WO2015127136 SEQ ID NO: 59 | 4015 |
| EBOL45 | Light chain variable region, Zaire ebolavirus (ZEBOV) glycoprotein | | WO2015127136 SEQ ID NO: 35 | 4016 |
| EBOL46 | Light chain variable region, Zaire ebolavirus (ZEBOV) glycoprotein | | WO2015127136 SEQ ID NO: 11 | 4017 |
| EBOL47 | light chain, Ebola virus glycoprotein | Fab Kz52 | Lee J. E. et al., Structure of the Ebola virus glycoprotein bound to an antibody from a human survivor; Nature 454 (7201), 177-182 (2008), NCBI Accession # 3CSY_H (217aa) | 4018 |

TABLE 19-continued

Antibodies against Ebola and Marburg viruses

| Antibody No. | Description | Antibody Name | Reference Information | SEQ ID NO |
|---|---|---|---|---|
| EBOL48 | Light chain, Ebolavirus-Protective Antibody | | Olal, D., et al., Structure of an Antibody in Complex with Its Mucin Domain Linear Epitope That Is Protective against Ebola Virus; J. Virol. 86 (5), 2809-2816 (2012), NCBI Accession # 2Y6S_L (217aa) | 4019 |
| EBOL49 | Light chain, Filovirus (Ebola or Marburg) | | US20140356354 SEQ ID NO: 12 | 4020 |
| EBOL50 | Light chain, Filovirus (Ebola or Marburg) | | US20140356354 SEQ ID NO: 13 | 4021 |
| EBOL51 | Light chain, Filovirus (Ebola or Marburg) | | US20140356354 SEQ ID NO: 14 | 4022 |
| EBOL52 | Light chain, Filovirus (Ebola or Marburg) | | US20140356354 SEQ ID NO: 15 | 4023 |
| EBOL53 | Light chain, Filovirus (Ebola or Marburg) | | US20140356354 SEQ ID NO: 16 | 4024 |

In one embodiment, the payload region of the AAV particle comprises one or more nucleic acid sequences, fragment or variants thereof or encodes one or more polypeptides, fragments or variants thereof described in U.S. Pat. No. 7,335,356 and EP Pub. No. EP1539238, the contents of each of which are herein incorporated by reference in their entirety, against Ebola.

In one embodiment, the payload region of the AAV particle comprises one or more nucleic acid sequences encoding one or more of the payload antibody polypeptides listed in Table 20 against Mosquito-borne disease.

TABLE 20

Antibodies against Mosquito-borne diseases

| Antibody No. | Description | Antibody Name | Reference Information | SEQ ID NO |
|---|---|---|---|---|
| MOSQ1 | Gamma heavy chain, partial, anti-Saint Louis encephalitis virus envelope glycoprotein immunoglobulin | | Thibodeaux, B. A. "Development of a human-murine chimeric immunoglobulin M antibody for use in the serological detection of human flavivirus antibodies", Clin. Vaccine Immunol. 16 (5), 679-685, 2009), NCBI Accession # ACI62179 | 4025 |
| MOSQ2 | Gamma heavy chain, partial, anti-Saint Louis encephalitis virus envelope glycoprotein immunoglobulin | | Thibodeaux, B. A. "Development of a human-murine chimeric immunoglobulin M antibody for use in the serological detection of human flavivirus antibodies", Clin. Vaccine Immunol. 16 (5), 679-685, 2009), NCBI Accession # ACI62180 | 4026 |
| MOSQ3 | Heavy chain variable region, Japanese encephalitis virus | anti-DLVR1/CLEC5A | US20080292644 SEQ ID NO: 69 | 4027 |
| MOSQ4 | Heavy chain variable region, Japanese encephalitis virus | anti-DLVR1/CLEC5A | US20080292644 SEQ ID NO: 70 | 4028 |
| MOSQ5 | Heavy chain variable region, Japanese encephalitis virus | anti-DLVR1/CLEC5A | US20080292644 SEQ ID NO: 71 | 4029 |
| MOSQ6 | Heavy chain variable region, Japanese encephalitis virus | | CN103864925 SEQ ID NO: 2 | 4030 |
| MOSQ7 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20480.1 | 4031 |

TABLE 20-continued

Antibodies against Mosquito-borne diseases

| Antibody No. | Description | Antibody Name | Reference Information | SEQ ID NO |
|---|---|---|---|---|
| MOSQ8 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20479.1 | 4032 |
| MOSQ9 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20478.1 | 4033 |
| MOSQ10 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20477.1 | 4034 |
| MOSQ11 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20476.1 | 4035 |
| MOSQ12 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20475.1 | 4036 |
| MOSQ13 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20474.1 | 4037 |
| MOSQ14 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20473.1 | 4038 |
| MOSQ15 | Heavy chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20472.1 | 4039 |
| MOSQ16 | Heavy chain variable region, partial sequence, WNV | | Throsby, M. "Isolation and characterization of human monoclonal antibodies from individuals infected with west nile virus" J. Virol. 80 (14), 6982-6992 (2006). NCBI Accession # ABF20471.1 | 4040 |
| MOSQ17 | Heavy chain variable region, WNV, Dengue, St. Louis encephalitis, yellow fever virus, Japanese encephalitis virus, Murray Valley encephalitis virus | mAbl 1 | WO2014144061 SEQ ID NO: 1 | 3359 |
| MOSQ18 | Heavy chain, WNV | CR4348 | U.S. Pat. No. 8,911,738 SEQ ID NO: 30 | 4041 |
| MOSQ19 | Heavy chain, WNV | CR4354 | U.S. Pat. No. 8,911,738 SEQ ID NO: 32 | 4042 |
| MOSQ20 | Heavy chain, WNV | CR4261 | U.S. Pat. No. 8,911,738 SEQ ID NO: 60 | 4043 |
| MOSQ21 | Heavy chain, WNV | CR4267 | U.S. Pat. No. 8,911,738 SEQ ID NO: 62 | 4044 |
| MOSQ22 | Heavy chain, WNV | CR4328 | U.S. Pat. No. 8,911,738 SEQ ID NO: 64 | 4045 |
| MOSQ23 | Heavy chain, WNV | CR4335 | U.S. Pat. No. 8,911,738 SEQ ID NO: 66 | 4046 |
| MOSQ24 | Heavy chain, WNV | CR4383 | U.S. Pat. No. 8,911,738 SEQ ID NO: 68 | 4047 |
| MOSQ25 | Heavy chain, WNV | CRM4354 | U.S. Pat. No. 8,911,738 SEQ ID NO: 148 | 4048 |
| MOSQ26 | Heavy chain variable region, WNV | Antibody from U.S. Pat. No. 8,911,738 | U.S. Pat. No. 8,911,738 SEQ ID NO: 20 | 4049 |
| MOSQ27 | Heavy chain variable region, WNV | E16 heavy chain version 1 | U.S. Pat. No. 7,572,456 SEQ ID NO: 21 | 4050 |
| MOSQ28 | Heavy chain variable region, WNV | E16 heavy chain version 2 | U.S. Pat. No. 7,572,456 SEQ ID NO: 22 | 4051 |
| MOSQ29 | Heavy chain variable region, WNV | E16 heavy chain version 3 | U.S. Pat. No. 7,572,456 SEQ ID NO: 23 | 4052 |
| MOSQ30 | Heavy chain variable region, WNV | Antibody from U.S. Pat. No. 8,911,738 | U.S. Pat. No. 8,911,738 SEQ ID NO: 18 | 4053 |
| MOSQ31 | Heavy chain variable region, WNV | hu-E16/E16p | U.S. Pat. No. 8,663,950 SEQ ID NO: 2 | 4054 |
| MOSQ32 | Heavy chain variable region, WNV | hu-E16/E16p | U.S. Pat. No. 8,663,950 SEQ ID NO: 3 | 4055 |

TABLE 20-continued

Antibodies against Mosquito-borne diseases

| Antibody No. | Description | Antibody Name | Reference Information | SEQ ID NO |
|---|---|---|---|---|
| MOSQ33 | Heavy chain variable region, WNV | E16 | U.S. Pat. No. 7,527,973 SEQ ID NO: 4 | 4056 |
| MOSQ34 | Heavy chain variable region, WNV | E24 | U.S. Pat. No. 7,527,973 SEQ ID NO: 8 | 4057 |
| MOSQ35 | Heavy chain variable region, WNV | E34 | U.S. Pat. No. 7,527,973 SEQ ID NO: 12 | 4058 |
| MOSQ36 | Heavy chain variable region, WNV | 11 | US20090130123 SEQ ID NO: 23 | 4059 |
| MOSQ37 | Heavy chain variable region, WNV | 71 | US20090130123 SEQ ID NO: 24 | 4060 |
| MOSQ38 | Heavy chain variable region, WNV | 73 | US20090130123 SEQ ID NO: 25 | 4061 |
| MOSQ39 | Heavy chain variable region, WNV | 85 | US20090130123 SEQ ID NO: 26 | 4062 |
| MOSQ40 | Heavy chain variable region, WNV | 15 | US20090130123 SEQ ID NO: 27 | 4063 |
| MOSQ41 | Heavy chain variable region, WNV | 95 | US20090130123 SEQ ID NO: 28 | 4064 |
| MOSQ42 | Heavy chain variable region, WNV | 84 | US20090130123 SEQ ID NO: 29 | 4065 |
| MOSQ43 | Heavy chain variable region, WNV | 10 | US20090130123 SEQ ID NO: 30 | 4066 |
| MOSQ44 | Heavy chain variable region, WNV | 69 | US20090130123 SEQ ID NO: 31 | 4067 |
| MOSQ45 | Heavy chain variable region, WNV | 79 | US20090130123 SEQ ID NO: 32 | 4068 |
| MOSQ46 | Heavy chain variable region, WNV | 94 | US20090130123 SEQ ID NO: 33 | 4069 |
| MOSQ47 | Heavy chain variable region, WNV | 9FI2 | WO2010093335 SEQ ID NO: 4 | 3333 |
| MOSQ48 | Heavy chain variable region, partial sequence, WMV | | Throsby, M. "Isolation and characterization of human monoclonal antibodies from individuals infected with west nile virus" J. Virol. 80 (14), 6982-6992 (2006), NCBI Accession # ABF20481.1 | 4070 |
| MOSQ49 | Heavy chain translation, WNV | hu-E16/E16p | U.S. Pat. No. 8,663,950 SEQ ID NO: 5 | 4071 |
| MOSQ50 | Heavy chain variable region, Yellow fever virus | anti-yellow fever virus vaccine strain 17D E glycoprotein | Thibodeaux, B. A. "A humanized IgG but not IgM antibody is effective in prophylaxis and therapy of yellow fever infection in an AG129/17D-204 peripheral challenge mouse model" Antiviral Res. 94 (1), 1-8 (2012), NCBI Accession # ADO17683 | 4072 |
| MOSQ51 | Light chain variable region, Japanese encephalitis virus | anti-DLVR1/CLEC5A | US20080292644 SEQ ID NO: 66 | 4073 |
| MOSQ52 | Light chain variable region, Japanese encephalitis virus | anti-DLVR1/CLEC5A | US20080292644 SEQ ID NO: 67 | 4074 |
| MOSQ53 | Light chain variable region, Japanese encephalitis virus | anti-DLVR1/CLEC5A | US20080292644 SEQ ID NO: 68 | 4075 |
| MOSQ54 | Light chain variable region, Japanese encephalitis virus | | CN103864925 SEQ ID NO: 1 | 4076 |
| MOSQ55 | Light chain variable region, WNV, Dengue, St. Louis encephalitis, yellow fever virus, Japanese encephalitis virus, Murray Valley encephalitis virus | mAbl 1 | WO2014144061 SEQ ID NO: 3 | 3418 |
| MOSQ56 | Light chain, WNV | CR4348 | U.S. Pat. No. 8,911,738 SEQ ID NO: 34 | 4077 |
| MOSQ57 | Light chain, WNV | CR4354 | U.S. Pat. No. 8,911,738 SEQ ID NO: 36 | 4078 |
| MOSQ58 | Light chain, WNV | CR4261 | U.S. Pat. No. 8,911,738 SEQ ID NO: 70 | 4079 |
| MOSQ59 | Light chain, WNV | CR4267 | U.S. Pat. No. 8,911,738 SEQ ID NO: 72 | 4080 |
| MOSQ60 | Light chain, WNV | CR4328 | U.S. Pat. No. 8,911,738 SEQ ID NO: 74 | 4081 |
| MOSQ61 | Light chain, WNV | CR4335 | U.S. Pat. No. 8,911,738 SEQ ID NO: 76 | 4082 |
| MOSQ62 | Light chain, WNV | CR4383 | U.S. Pat. No. 8,911,738 SEQ ID NO: 78 | 4083 |
| MOSQ63 | Light chain variable region, WNV | Antibody from U.S. Pat. No. 8,911,738 | U.S. Pat. No. 8,911,738 SEQ ID NO: 22 | 4084 |
| MOSQ64 | Light chain variable region, WNV | Antibody from U.S. Pat. No. 8,911,738 | U.S. Pat. No. 8,911,738 SEQ ID NO: 24 | 4085 |

TABLE 20-continued

Antibodies against Mosquito-borne diseases

| Antibody No. | Description | Antibody Name | Reference Information | SEQ ID NO |
|---|---|---|---|---|
| MOSQ65 | Light chain variable region, WNV | E16 | U.S. Pat. No. 7,527,973 SEQ ID NO: 2 | 4086 |
| MOSQ66 | Light chain variable region, WNV | E24 | U.S. Pat. No. 7,527,973 SEQ ID NO: 6 | 4087 |
| MOSQ67 | Light chain variable region, WNV | E34 | U.S. Pat. No. 7,527,973 SEQ ID NO: 10 | 4088 |
| MOSQ68 | Light chain variable region, WNV | E16 light chain version 1 | U.S. Pat. No. 7,572,456 SEQ ID NO: 25 | 4089 |
| MOSQ69 | Light chain variable region, WNV | E16 light chain version 2 | U.S. Pat. No. 7,572,456 SEQ ID NO: 26 | 4090 |
| MOSQ70 | Light chain variable region, WNV | 11 | US20090130123 SEQ ID NO: 34 | 4091 |
| MOSQ71 | Light chain variable region, WNV | 71 | US20090130123 SEQ ID NO: 35 | 4092 |
| MOSQ72 | Light chain variable region, WNV | 73 | US20090130123 SEQ ID NO: 36 | 4093 |
| MOSQ73 | Light chain variable region, WNV | 85 | US20090130123 SEQ ID NO: 37 | 4094 |
| MOSQ74 | Light chain variable region, WNV | 15 | US20090130123 SEQ ID NO: 38 | 4095 |
| MOSQ75 | Light chain variable region, WNV | 95 | US20090130123 SEQ ID NO: 39 | 4096 |
| MOSQ76 | Light chain variable region, WNV | 84 | US20090130123 SEQ ID NO: 40 | 4097 |
| MOSQ77 | Light chain variable region, WNV | 10 | US20090130123 SEQ ID NO: 41 | 4098 |
| MOSQ78 | Light chain variable region, WNV | | US20090130123 SEQ ID NO: 42 | 4099 |
| MOSQ79 | Light chain variable region, WNV | 79 | US20090130123 SEQ ID NO: 43 | 4100 |
| MOSQ80 | Light chain variable region, WNV | 94 | US20090130123 SEQ ID NO: 44 | 4101 |
| MOSQ81 | Light chain variable region, WNV | 9FI2 | WO2010093335 SEQ ID NO: 6 | 3393 |
| MOSQ82 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20470.1 | 4102 |
| MOSQ83 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20469.1 | 4103 |
| MOSQ84 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20468.1 | 4104 |
| MOSQ85 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20467.1 | 4105 |
| MOSQ86 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20466.1 | 4106 |
| MOSQ87 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20465.1 | 4107 |
| MOSQ88 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20464.1 | 4108 |
| MOSQ89 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20463.1 | 4109 |

TABLE 20-continued

Antibodies against Mosquito-borne diseases

| Antibody No. | Description | Antibody Name | Reference Information | SEQ ID NO |
|---|---|---|---|---|
| MOSQ90 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20462.1 | 4110 |
| MOSQ91 | Light chain variable region, partial sequence, WNV | | Throsby, M. "Isolation and characterization of human monoclonal antibodies from individuals infected with west nile virus" J, Virol. 80 (14), 6982-6992 (2006), NCBI Accession # ABF20461.1 | 4111 |
| MOSQ92 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20460.1 | 4112 |
| MOSQ93 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20459.1 | 4113 |
| MOSQ94 | Light chain variable region, partial sequence, WNV | | Throsby, M. "Isolation and characterization of human monoclonal antibodies from individuals infected with west nile virus" J. Virol. 80 (14), 6982-6992 (2006), NCBI Accession # ABF20458.1 | 4114 |
| MOSQ95 | Light chain translation, WNV | hu-E16/E16p | U.S. Pat. No. 8,663,950 SEQ ID NO: 7 | 4115 |
| MOSQ96 | Light chain variable region, Yellow fever virus | anti-yellow fever virus vaccine strain 17D E glycoprotein | Thibodeaux, B. A. "A humanized IgG but not IgM antibody is effective in prophylaxis and therapy of yellow fever infection in an AG129/17D-204 peripheral challenge mouse model" Antiviral Res. 94 (1), 1-8 (2012), NCBI Accession # ADO17684 | 4116 |
| MOSQ97 | ScFv, WNV | 9FI2 | WO2010093335 SEQ ID NO: 8 | 3442 |
| MOSQ98 | Fc region, WNV, Dengue, St. Louis encephalitis, yellow fever virus, Japanese encephalitis virus, Murray Valley encephalitis virus | mAb-11 | WO2014144061 SEQ ID NO: 5 | 4117 |
| MOSQ99 | Fc region, WNV, Dengue, St. Louis encephalitis, yellow fever virus, Japanese encephalitis virus, Murray Valley encephalitis virus | mAb-11-LALA | WO2014144061 SEQ ID NO: 6 | 4118 |
| MOSQ100 | ScFv, WNV | 11 | US20090130123 SEQ ID NO: 12 | 4119 |
| MOSQ101 | ScFv, WNV | 71 | US20090130123 SEQ ID NO: 13 | 4120 |
| MOSQ102 | ScFv, WNV | 73 | US20090130123 SEQ ID NO: 14 | 4121 |
| MOSQ103 | ScFv, WNV | 85 | US20090130123 SEQ ID NO: 15 | 4122 |
| MOSQ104 | ScFv, WNV | 15 | US20090130123 SEQ ID NO: 16 | 4123 |
| MOSQ105 | ScFv, WNV | 95 | US20090130123 SEQ ID NO: 17 | 4124 |
| MOSQ106 | ScFv, WNV | 84 | US20090130123 SEQ ID NO: 18 | 4125 |
| MOSQ107 | ScFv, WNV | 10 | US20090130123 SEQ ID NO: 19 | 4126 |
| MOSQ108 | ScFv, WNV | 69 | US20090130123 SEQ ID NO: 20 | 4127 |
| MOSQ109 | ScFv, WNV | 79 | US20090130123 SEQ ID NO: 21 | 4128 |
| MOSQ110 | ScFv, WNV | 94 | US20090130123 SEQ ID NO: 22 | 4129 |
| MOSQ111 | ScFvs, WNV | SC04-348 | U.S. Pat. No. 8,911,738 SEQ ID NO: 26 | 4130 |
| MOSQ112 | ScFvs, WNV | SC04-354 | U.S. Pat. No. 8,911,738 SEQ ID NO: 28 | 4131 |
| MOSQ113 | ScFv, Yellow fever virus | anti-yellow fever virus E protein scFv 7A | Daffis, S. et al. "Antibody responses against wild-type yellow fever virus and the 17D vaccine strain: characterization with human monoclonal antibody fragments and neutralization escape variants" Virology 337 (2), 262-272 (2005), NCBI Accession # AAT76799 | 4132 |
| MOSQ114 | ScFv, Yellow fever virus | anti-yellow fever virus E protein scFv R3(27) | Daffis, S. et al. "Antibody responses against wild-type yellow fever virus and the 17D vaccine strain: characterization with human monoclonal antibody fragments and neutralization escape variants" Virology 337 | 4133 |

TABLE 20-continued

Antibodies against Mosquito-borne diseases

| Antibody No. | Description | Antibody Name | Reference Information | SEQ ID NO |
|---|---|---|---|---|
| MOSQ115 | ScFv, Yellow fever virus | anti-yellow fever virus E protein scFv 5A | (2), 262-272 (2005), NCBI Accession # AAT76800 Daffis, S. et al. "Antibody responses against wild-type yellow fever virus and the 17D vaccine strain: characterization with human monoclonal antibody fragments and neutralization escape variants" Virology 337 (2), 262-272 (2005), NCBI Accession # AAT76801 | 4134 |
| MOSQ116 | ScFv, Yellow fever virus | anti-yellow fever virus E protein scFv 1A | Daffis, S. et al. "Antibody responses against wild-type yellow fever virus and the 17D vaccine strain: characterization with human monoclonal antibody fragments and neutralization escape variants" Virology 337 (2), 262-272 (2005), NCBI Accession # AAT76802 | 4135 |
| MOSQ117 | ScFv, Yellow fever virus | anti-yellow fever virus E protein scFv 2A | Daffis, S. et al. "Antibody responses against wild-type yellow fever virus and the 17D vaccine strain: characterization with human monoclonal antibody fragments and neutralization escape variants" Virology 337 (2), 262-272 (2005), NCBI Accession # AAT76803 | 4136 |
| MOSQ118 | ScFv, Yellow fever virus | anti-yellow fever virus E protein scFv R3(9) | Daffis, S. et al. "Antibody responses against wild-type yellow fever virus and the 17D vaccine strain: characterization with human monoclonal antibody fragments and neutralization escape variants" Virology 337 (2), 262-272 (2005), NCBI Accession # AAT76804 | 4137 |

In one embodiment, the payload region of the AAV particle comprises one or more nucleic acid sequences, fragment or variants thereof or encodes one or more polypeptides, fragments or variants thereof described in U.S. Pat. No. 6,399,062 and US Pub. No. US20110171225, the contents of each of which are herein incorporated by reference in their entirety, against Malaria.

Infectious Diseases

In one embodiment, the payload region of the AAV particle comprises one or more nucleic acid sequences encoding one or more of the infectious disease related payload anti body polypeptides listed in Tables 21-42.

In one embodiment, the payload region of the AAV particle comprises one or more nucleic acid sequences encoding one or more of the payload antibody polypeptides listed in Table 21 against Influenza virus

TABLE 21

Antibodies against Influenza virus

| Antibody No. | Description | Antibody Name | Reference Information | SEQ ID NO |
|---|---|---|---|---|
| INFL1 | Fab Fragment Heavy chain | ch65 | Whittle, J. R. et al., Broadly neutralizing human antibody that recognizes the receptor-binding pocket of influenza virus hemagglutinin; Proc. Natl. Acad. Sci. U.S.A. 108 (34), 14216-14221 (2011), NCBI Accession #3SMS_H | 4138 |
| INFL2 | Fab Heavy Chain | Fab Cr6261 (Somatic Heavy Chain With Germline-Reverted Light Chain) | Lingwood, D., et al., Structural and genetic basis for development of broadly neutralizing influenza antibodies; Nature 489 (7417), 566-570 (2012), NCBI Accession #4EVN_M (242aa) | 4139 |
| INFL3 | Fab heavy chain | Del2d1 | Krause, J. C. et al., M Bio 2 (1), E00345-E00310 (2011), NCBI Accession #3QHF_H | 4140 |
| INFL4 | Fab heavy chain | Fld194 Fab | Xiong, X. et al., Structures of complexes formed by H5 influenza hemagglutinin with a potent broadly neutralizing human monoclonal antibody; Proc. Natl. Acad. Sci. U.S.A. 112 (30), 9430-9435 (2015), NCBI Accession #5A3I_C (230aa) | 4141 |

TABLE 21-continued

Antibodies against Influenza virus

| Antibody No. | Description | Antibody Name | Reference Information | SEQ ID NO |
|---|---|---|---|---|
| INFL5 | Fab heavy chain | H5.3 | Winarski, K. L., Thornburg, N. J. et al., Vaccine-elicited antibody that neutralizes H5N1 influenza and variants binds the receptor site and polymorphic sites "PNAS 2015 112 (30) 9346-9351", NCBI Accession #4XNM_H | 4142 |
| INFL6 | Fab Heavy chain | 5j8 | Hong, M. et al., Antibody Recognition of the Pandemic H1N1 Influenza Virus Hemagglutinin Receptor Binding Site; J. Virol. 87 (22), 12471-12480 (2013), NCBI Accession #4M5Z_H | 4143 |
| INFL7 | Fab lambda heavy chain | CR6261 | Ekiert, D. C. et al., Antibody recognition of a highly conserved influenza virus epitope; Science 324 (5924), 246-251 (2009), NCBI Accession #3GBN_H | 4144 |
| INFL8 | Fab lambda light chain | CR6261 | Ekiert, D. C. et al., Antibody recognition of a highly conserved influenza virus epitope; Science 324 (5924), 246-251 (2009), NCBI Accession #3GBN_L | 4145 |
| INFL9 | Fab lambda light chain | Fab Cr6261 (Somatic Heavy Chain With Germline-Reverted Light Chain) | Lingwood, D., et al., Structural and genetic basis for development of broadly neutralizing influenza antibodies; Nature 489 (7417), 566-570 (2012), NCBI Accession #4EVN_N (217aa) | 4146 |
| INFL10 | Fab light chain | Del2d1 | Krause, J. C. et al., M Bio 2 (1), E00345-E00310 (2011), NCBI Accession #3QHF_L | 4147 |
| INFL11 | Fab Light Chain | Fld194 Fab | Xiong, X. et al., Structures of complexes formed by H5 influenza hemagglutinin with a potent broadly neutralizing human monoclonal antibody; Proc. Natl. Acad, Sci. U.S.A. 112 (30), 9430-9435 (2015), NCBI Accession #5A3I_D (219aa) | 4148 |
| INFL12 | Fab, heavy chain | F045-092 | Lee, P. S. et al., Receptor mimicry by antibody F045-092 facilitates universal binding to the H3 subtype of influenza virus; Nat Commun 5, 3614 (2014), NCBI Accession #4O5I_W | 4149 |
| INFL13 | Fab, Light Chain | F045-092 | Lee, P. S. et al., Receptor mimicry by antibody F045-092 facilitates universal binding to the H3 subtype of influenza virus; Nat Commun 5, 3614 (2014), NCBI Accession #4O5I_V | 4150 |
| INFL14 | Fab, light chain | H5.3 | Winarski, K. L., Thornburg, N. J. et al., "Vaccine-elicited antibody that neutralizes H5N1 influenza and variants binds the receptor site and polymorphic sites "PNAS 2015 112 (30) 9346-9351", NCBI Accession #4XNM_L | 4151 |
| INFL15 | Gamma heavy chain variable | 8i10 | U.S. Pat. No. 8,858,948 SEQ ID NO: 69 | 4152 |
| INFL16 | Gamma heavy chain variable | 23K12 | U.S. Pat. No. 8,858,948 SEQ ID NO: 100 | 4153 |
| INFL17 | Heavy chain | CR6261, Diridavumab, CR-6261 | WO 2008028946 | 4154 |
| INFL18 | Heavy chain | Firivumab, CT-P22 | US20130004505 | 4155 |
| INFL19 | Heavy chain | CT-P22 | US20130004505 SEQ ID NO: 41; WO 2011/111966 | 4156 |
| INFL20 | Heavy chain | Navivumab, CT149 | WO2013048153, US20140234336 SEQ ID NO: 40 | 4157 |
| INFL21 | Heavy chain | AT10-004 | US20150010566, WO2013081463 SEQ ID NO: 31 | 4158 |
| INFL22 | Heavy chain | AT10-003 | US20150010566, WO2013081463 SEQ ID NO: 32 | 4159 |
| INFL23 | Heavy chain | AT10-002 | US20150010566, WO2013081463 SEQ ID NO: 33 | 4160 |
| INFL24 | Heavy chain | AT10-001 | US20150010566, WO2013081463 SEQ ID NO: 34 | 4161 |
| INFL25 | Heavy chain | AT10-005 | US20150010566, WO2013081463 SEQ ID NO: 35 | 4162 |
| INFL26 | Heavy chain | CT104 | WO2011111966, US20130004505 SEQ ID NO: 37 | 4163 |

TABLE 21-continued

Antibodies against Influenza virus

| Antibody No. | Description | Antibody Name | Reference Information | SEQ ID NO |
|---|---|---|---|---|
| INFL27 | Heavy chain | CT120 | WO2011111966, US20130004505 SEQ ID NO: 41 | 4164 |
| INFL28 | Heavy chain | CT123 | WO2011111966, US20130004505 SEQ ID NO: 45 | 4165 |
| INFL29 | Heavy chain | 2A | US20140011982 SEQ ID NO: 2 | 4166 |
| INFL30 | Heavy chain | F005-126 | WO2014049520, US20140086927 SEQ ID NO: 2 | 4167 |
| INFL31 | Heavy chain | BF1-1 | WO2008156763 SEQ ID NO: 7 | 4168 |
| INFL32 | Heavy chain | BF1-19 | WO2008156763 SEQ ID NO: 11 | 4169 |
| INFL33 | Heavy chain | BF1-10 | WO2008156763 SEQ ID NO: 9 | 4170 |
| INFL34 | Heavy chain | | WO2010127252, U.S. Pat. No. 8,894,997 SEQ ID NO: 3 | 4171 |
| INFL35 | Heavy chain | A18 | WO13170139 SEQ ID NO: 94 | 4172 |
| INFL36 | Heavy chain | Ab A18 | U.S. Pat. No. 7,788,200 SEQ ID NO: 15 | 4173 |
| INFL37 | Heavy chain | Ab 014, Ab 028 | U.S. Pat. No. 7,788,200 SEQ ID NO: 16 | 4174 |
| INFL38 | Heavy chain | Ab 071 | U.S. Pat. No. 7,788,200 SEQ ID NO: 162 | 4175 |
| INFL39 | Heavy chain | Ab 072 | U.S. Pat. No. 7,788,200 SEQ ID NO: 163 | 4176 |
| INFL40 | Heavy chain | Ab 078, Ab 079, Ab 080, Ab 081 | U.S. Pat. No. 7,788,200 SEQ ID NO: 164 | 4177 |
| INFL41 | Heavy chain | Ab 001, Ab 009, Ab 017, Ab 160, Ab 186, Ab 187, Ab 188, Ab 189, Ab 190, Ab 191, Ab 192, Ab 193, Ab 202, Ab 211 | U.S. Pat. No. 7,788,200 SEQ ID NO: 17 | 4178 |
| INFL42 | Heavy chain | Ab 002, Ab 010, Ab 026, Ab 203, Ab 212 | U.S. Pat. No. 7,788,200 SEQ ID NO: 18 | 4179 |
| INFL43 | Heavy chain | Ab 003, Ab 011, Ab 027, Ab 194, Ab 195, Ab 196, Ab 197, Ab 198, Ab 199, Ab 200, Ab 204, Ab 213 | U.S. Pat. No. 7,788,200 SEQ ID NO: 19 | 4180 |
| INFL44 | Heavy chain | Ab 086 | U.S. Pat. No. 7,788,200 SEQ ID NO: 20 | 4181 |
| INFL45 | Heavy chain | Ab 154, Ab 155, Ab 157 | U.S. Pat. No. 7,788,200 SEQ ID NO: 21 | 4182 |
| INFL46 | Heavy chain | Ab 157, Ab 159 | U.S. Pat. No. 7,788,200 SEQ ID NO: 22 | 4183 |
| INFL47 | Heavy chain | Ab 210, Ab 219 | U.S. Pat. No. 7,788,200 SEQ ID NO: 23 | 4184 |
| INFL48 | Heavy chain | Ab A001, Ab A002, Ab A003, Ab A010, Ab A011, Ab 031, Ab 037 | U.S. Pat. No. 7,788,200 SEQ ID NO: 24 | 4185 |
| INFL49 | Heavy chain | Ab 004, Ab 005, Ab 006, Ab 012, Ab 013, Ab 032, Ab 038, Ab 043, Ab 044, Ab 045, Ab 046, Ab 047, Ab 048, Ab 049, Ab 050, Ab 051, Ab 052, Ab 067, Ab 068, Ab 069, Ab 070, Ab 073, Ab 074, Ab 075, Ab 076, Ab 077 | U.S. Pat. No. 7,788,200 SEQ ID NO: 25 | 4186 |
| INFL50 | Heavy chain | Ab 007, Ab 008, Ab A009, Ab A14, Ab 015, Ab 033, Ab 039 | U.S. Pat. No. 7,788,200 SEQ ID NO: 26 | 4187 |
| INFL51 | Heavy chain | Ab 016, Ab A017, Ab C18, Ab A019, Ab 034, Ab 040 | U.S. Pat. No. 7,788,200 SEQ ID NO: 27 | 4188 |
| INFL52 | Heavy chain | F005-126 | WO2014049520 SEQ ID 2 | 4189 |
| INFL53 | Heavy chain | 8f24 | WO2012045001 SEQ ID 1 | 4190 |
| INFL54 | Heavy chain | 3E22 | WO2012045001 SEQ ID 5 | 4191 |
| INFL55 | Heavy chain | 5I17 | WO2012045001 SEQ ID 9 | 4192 |
| INFL56 | Heavy chain | | WO2012045001 SEQ ID 13 | 4193 |
| INFL57 | Heavy chain | | WO2012045001 SEQ ID 29 | 4194 |
| INFL58 | Heavy chain | | WO2012045001 SEQ ID 33 | 4195 |
| INFL59 | Heavy chain | | WO2012045001 SEQ ID 17 | 4196 |
| INFL60 | Heavy chain | 10A14 | WO2012045001 SEQ ID 21 | 4197 |

TABLE 21-continued

Antibodies against Influenza virus

| Antibody No. | Description | Antibody Name | Reference Information | SEQ ID NO |
|---|---|---|---|---|
| INFL61 | Heavy chain | 8D4 | WO2012045001 SEQ ID 25 | 4198 |
| INFL62 | Heavy chain | 2B9 | U.S. Pat. No. 9,115,201 SEQ ID NO: 6 | 4199 |
| INFL63 | Heavy chain | mAB 7A7 | US20150239960, US20140170163, U.S. Pat. No. 8,673,314, US20110027270, WO2010138564 SEQ ID NO: 6 | 4200 |
| INFL64 | Heavy chain | mAB 12D1 | US20150239960, US20140170163, U.S. Pat. No. 8,673,314, US20110027270, WO2010138564 SEQ ID NO: 12 | 4201 |
| INFL65 | Heavy chain | mAB 66A6 | US20150239960, US20140170163, U.S. Pat. No. 8,673,314, US20110027270, WO2010138564 SEQ ID NO: 16 | 4202 |
| INFL66 | Heavy chain | M1 D12 | US20110033473, WO2009125395 SEQ ID NO: 17 | 4203 |
| INFL67 | Heavy chain | mAB1.12 | WO2013030165 SEQ ID NO: 1 | 4204 |
| INFL68 | Heavy chain | mAB3.1 | WO2013030165 SEQ ID NO: 3 | 4205 |
| INFL69 | Heavy chain | 5A7 | WO2015120097 SEQ ID NO: 7 | 4206 |
| INFL70 | Heavy chain | TRL053 | WO2015120097 SEQ ID NO: 17 | 4207 |
| INFL71 | Heavy chain | TRL579 | WO2015120097 SEQ ID NO: 27 | 4208 |
| INFL72 | Heavy chain | TRL784 | WO2015120097 SEQ ID NO: 37 | 4209 |
| INFL73 | Heavy chain | TRL794 | WO2015120097 SEQ ID NO: 47 | 4210 |
| INFL74 | Heavy chain | TRL798 | WO2015120097 SEQ ID NO: 57 | 4211 |
| INFL75 | Heavy chain | TRL799 | WO2015120097 SEQ ID NO: 67 | 4212 |
| INFL76 | Heavy chain | TRL809 | WO2015120097 SEQ ID NO: 77 | 4213 |
| INFL77 | Heavy chain | TRL811 | WO2015120097 SEQ ID NO: 87 | 4214 |
| INFL78 | Heavy chain | TRL812 | WO2015120097 SEQ ID NO: 97 | 4215 |
| INFL79 | Heavy chain | TRL813 | WO2015120097 SEQ ID NO: 107 | 4216 |
| INFL80 | Heavy chain | TRL823 | WO2015120097 SEQ ID NO: 117 | 4217 |
| INFL81 | Heavy chain | TRL832 | WO2015120097 SEQ ID NO: 127 | 4218 |
| INFL82 | Heavy chain | TRL833 | WO2015120097 SEQ ID NO: 137 | 4219 |
| INFL83 | Heavy chain | TRL834 | WO2015120097 SEQ ID NO: 147 | 4220 |
| INFL84 | Heavy chain | TRL835 | WO2015120097 SEQ ID NO: 157 | 4221 |
| INFL85 | Heavy chain | TRL835 | WO2015120097 SEQ ID NO: 158 | 4222 |
| INFL86 | Heavy chain | TRL837 | WO2015120097 SEQ ID NO: 168 | 4223 |
| INFL87 | Heavy chain | TRL839 | WO2015120097 SEQ ID NO: 178 | 4224 |
| INFL88 | Heavy chain | TRL841 | WO2015120097 SEQ ID NO: 188 | 4225 |
| INFL89 | Heavy chain | TRL842 | WO2015120097 SEQ ID NO: 198 | 4226 |
| INFL90 | Heavy chain | TRL845 | WO2015120097 SEQ ID NO: 208 | 4227 |
| INFL91 | Heavy chain | TRL846 | WO2015120097 SEQ ID NO: 217 | 4228 |
| INFL92 | Heavy chain | TRL847 | WO2015120097 SEQ ID NO: 227 | 4229 |
| INFL93 | Heavy chain | TRL848 | WO2015120097 SEQ ID NO: 237 | 4230 |
| INFL94 | Heavy chain | TRL849 | WO2015120097 SEQ ID NO: 247 | 4231 |
| INFL95 | Heavy chain | TRL851 | WO2015120097 SEQ ID NO: 257 | 4232 |
| INFL96 | Heavy chain | TRL854 | WO2015120097 SEQ ID NO: 267 | 4233 |
| INFL97 | Heavy chain | TRL856 | WO2015120097 SEQ ID NO: 277 | 4234 |
| INFL98 | Heavy chain | TRL858 | WO2015120097 SEQ ID NO: 287 | 4235 |
| INFL99 | Heavy chain | humM2e-hBiTE-1 | WO2014140368 SEQ ID NO: 8 | 4236 |
| INFL100 | Heavy chain | humM2e-hBiTE-2 | WO2014140368 SEQ ID NO: 16 | 4237 |
| INFL101 | Heavy chain | humM2e-hBiTE-3 | WO2014140368 SEQ ID NO: 24 | 4238 |
| INFL102 | Heavy chain | humM2e-hBiTE-4 | WO2014140368 SEQ ID NO: 32 | 4239 |
| INFL103 | Heavy chain | VH of humM2e-hBiTE-5 | WO2014140368 SEQ ID NO: 40 | 4240 |
| INFL104 | Heavy chain | humM2e-hBiTE-6 | WO2014140368 SEQ ID NO: 48 | 4241 |
| INFL105 | Heavy chain | humM2e-hBiTE-7 | WO2014140368 SEQ ID NO: 56 | 4242 |
| INFL106 | Heavy chain | humM2e-hBiTE-8 | WO2014140368 SEQ ID NO: 64 | 4243 |
| INFL107 | Heavy chain | humM2e-hBiTE-9 | WO2014140368 SEQ ID NO: 72 | 4244 |
| INFL108 | Heavy chain | murM2e-hBiTE | WO2014140368 SEQ ID NO: 80 | 4245 |
| INFL109 | Heavy chain | FLA5.10 | U.S. Pat. No. 8,124,092 SEQ ID NO: 1 | 4246 |
| INFL110 | Heavy chain | FLD21.140 | U.S. Pat. No. 8,124,092 SEQ ID NO: 5 | 4247 |
| INFL111 | Heavy chain | FLA3.14 | U.S. Pat. No. 8,124,092 SEQ ID NO: 9 | 4248 |
| INFL112 | Heavy chain | FLD20.19 | U.S. Pat. No. 8,124,092 SEQ ID NO: 13 | 4249 |
| INFL113 | Heavy chain | FLD84 | U.S. Pat. No. 8,124,092 SEQ ID NO: 42 | 4250 |
| INFL114 | Heavy chain | FLD93 | U.S. Pat. No. 8,124,092 SEQ ID NO: 52 | 4251 |
| INFL115 | Heavy chain | FLD122 | U.S. Pat. No. 8,124,092 SEQ ID NO: 62 | 4252 |
| INFL116 | Heavy chain | FLD127 | U.S. Pat. No. 8,124,092 SEQ ID NO: 72 | 4253 |
| INFL117 | Heavy chain | FLD129 | U.S. Pat. No. 8,124,092 SEQ ID NO: 82 | 4254 |
| INFL118 | Heavy chain | FLD132 | U.S. Pat. No. 8,124,092 SEQ ID NO: 92 | 4255 |
| INFL119 | Heavy chain | FLD194 | U.S. Pat. No. 8,124,092 SEQ ID NO: 102 | 4256 |
| INFL120 | Heavy chain | mAb2 | WO2015112994 SEQ ID NO: 80 | 4257 |
| INFL121 | Heavy chain | mAb3 | WO2015112994 SEQ ID NO: 84 | 4258 |
| INFL122 | Heavy chain | | Tsibane, T. et al., Influenza Human Monoclonal Antibody 1F1 Interacts with Three Major Antigenic Sites and Residues Mediating Human Receptor Specificity in H1N1 Viruses; PLoS | 4259 |

TABLE 21-continued

Antibodies against Influenza virus

| Antibody No. | Description | Antibody Name | Reference Information | SEQ ID NO |
|---|---|---|---|---|
| INFL123 | Heavy chain | C05 | Pathol. 8 (12), E1003067 (2012), NCBI Accession #4GXU_S Ekiert, D. C., et al., Cross-neutralization of influenza A viruses mediated by a single antibody loop; Nature 489 (7417), 526-532 (2012), NCBI Accession #4FNL_H (247aa) | 4260 |
| INFL124 | Heavy chain | CR8020 | Ekiert, D. C., et al., A. highly conserved neutralizing epitope on group 2 influenza A viruses; Science 333 (6044), 843-850 (2011); WO2010130636, NCBI Accession #3SDY_H | 4261 |
| INFL125 | Heavy chain | CR8043 | Friesen, R. H. et al., A common solution to group 2 influenza virus neutralization; Proc. Natl. Acad. Sci. U.S.A. 111 (1), 445-450 (2014), NCBI Accession #4NM8_H | 4262 |
| INFL126 | Heavy chain | CR8059 | Dreyfus, C. et al., Highly conserved protective epitopes on influenza B viruses; Science 337 (6100), 1343-1348 (2012), NCBI Accession #4FQK_H | 4263 |
| INFL127 | Heavy chain | CR8071 | Dreyfus, C. et al., Highly conserved protective epitopes on influenza B viruses; Science 337 (6100), 1343-1348 (2012), NCBI Accession #4FQJ_H (234aa) | 4264 |
| INFL128 | Heavy chain | CR9114 | WO2013079473; WO2014191435; Dreyfus, C., Laursen, N. S. et al., Highly conserved protective epitopes on influenza B viruses; Science 337 (6100), 1343-1348 (2012), NCBI Accession #4FQY_H (230aa) | 4265 |
| INFL129 | Heavy chain | Ch67 | Schmidt, A. G., et al., Preconfiguration of the antigen-binding site during affinity maturation of a broadly neutralizing influenza virus antibody; Proc. Natl. Acad. Set. U.S.A. 110 (1), 264-269 (2013), NCBI Accession #4HKX_A (231aa) | 4266 |
| INFL130 | Heavy chain | Fab 26/9 | Schulze-Gahmen, U. et al., J. Biol. Chem. 263 (32), 17100-17105 (1988); Churchill, M. E., et al., J. Mol. Biol. 241 (4), 534-556 (1994), NCBI Accession #1FRG_H | 4267 |
| INFL131 | Heavy chain | Fab 3.1 | Wyrzucki, A. et al., Alternative Recognition of the Conserved Stem Epitope in Influenza A Virus Hemagglutinin by a VH3-30-Encoded Heterosubtypic Antibody; J. Virol. 88 (12), 7083-7092 (2014), NCBI Accession #4PY8_I | 4268 |
| INFL132 | Heavy chain | Fab 2g1 | Xu, R. et al., A recurring motif for antibody recognition of the receptor-binding site of influenza hemagglutinin; Nat. Struct. Mol. Biol. 20 (3), 363-370 (2013), NCBI Accession #4HG4_N (223aa) | 4269 |
| INFL133 | Heavy chain | Fab 8m2 | Xu, R. et al., A recurring motif for antibody recognition of the receptor-binding site of influenza hemagglutinin; Nat. Struct. Mol. Biol. 20 (3), 363-370 (2013), NCBI Accession #4HFU_H (226aa) | 4270 |
| INFL134 | Heavy chain | Fab 8f8 | Xu, R. et al., A recurring motif for antibody recognition of the receptor-binding site of influenza hemagglutinin; Nat. Struct. Mol. Biol. 20 (3), 363-370 (2013), NCBI Accession #4HF5_H (233aa) | 4271 |
| INFL135 | Heavy chain | Fab 2d1 | Xu, R., et al., Structural basis of preexisting immunity to the 2009 H1N1 pandemic influenza virus; Science 328 (5976), 357-360 (2010), NCBI Accession #3LZF_H (230aa) | 4272 |

TABLE 21-continued

Antibodies against Influenza virus

| Antibody No. | Description | Antibody Name | Reference Information | SEQ ID NO |
|---|---|---|---|---|
| INFL136 | Heavy chain | Fi6v3 | Corti, D. et al., A neutralizing antibody selected from plasma cells that binds to group 1 and group 2 influenza A hemagglutinins; Science 333 (6044), 850-856 (2011), NCBI Accession #3ZTJ_G | 4273 |
| INFL137 | Heavy Chain | Heavy chain 3WHE_N | Iba, Y., et al., Conserved Neutralizing Epitope at Globular Head of Hemagglutinin in H3N2 Influenza Viruses; J. Virol. (2014), NCBI Accession #3WHE_M (226aa) | 4274 |
| INFL138 | Heavy chain | 7A13 | Krause et al. "Human Monoclonal Antibodies to Pandemic 1957 H2N2 and Pandemic 1968 H3N2 Influenza Viruses" J. Virol. 86 (11), 6334-6340 (2012), NCBI Accession #AFH78447 | 4275 |
| INFL139 | Heavy chain | 2D1 | WO2010127252, U.S. Pat. No. 8,894,997 SEQ ID NO: 7 | 4276 |
| INFL140 | Heavy chain | 1F1 | WO2010127252, U.S. Pat. No. 8,894,997 SEQ ID NO: 1 | 4277 |
| INFL141 | Heavy chain | | WO2010127252, U.S. Pat. No. 8,894,997 SEQ ID NO: 4 | 4278 |
| INFL142 | Heavy chain | 1I20 | WO2010127252, U.S. Pat. No. 8,894,997 SEQ ID NO: 5 | 4279 |
| INFL143 | Heavy chain | 4D20 | WO2010127252, U.S. Pat. No. 8,894,997 SEQ ID NO: 9 | 4280 |
| INFL144 | Heavy chain | | WO2010127252, U.S. Pat. No. 8,894,997 SEQ ID NO: 11 | 4281 |
| INFL145 | Heavy chain | | US20140205614, US20100316654 SEQ ID NO: 21 | 4282 |
| INFL146 | Heavy chain | | US20140205614, US20100316654 SEQ ID NO: 22 | 4283 |
| INFL147 | Heavy chain | | US20140205614, US20100316654 SEQ ID NO: 23 | 4284 |
| INFL148 | Heavy chain | | US20140205614, US20100316654 SEQ ID NO: 24 | 4285 |
| INFL149 | Heavy chain | | US20140205614, US20100316654 SEQ ID NO: 25 | 4286 |
| INFL150 | Heavy chain | | US20140205614, US20100316654 SEQ ID NO: 26 | 4287 |
| INFL151 | Heavy chain | | US20140205614, US20100316654 SEQ ID NO: 27 | 4288 |
| INFL152 | Heavy chain | | US20140205614, US20100316654 SEQ ID NO: 28 | 4289 |
| INFL153 | Heavy chain | | US20140205614, US20100316654 SEQ ID NO: 29 | 4290 |
| INFL154 | Heavy chain | | US20140205614, US20100316654 SEQ ID NO: 30 | 4291 |
| INFL155 | Heavy chain | | US20140205614, US20100316654 SEQ ID NO: 31 | 4292 |
| INFL156 | Heavy chain | | US20140205614, US20100316654 SEQ ID NO: 32 | 4293 |
| INFL157 | Heavy chain | | US20140205614, US20100316654 SEQ ID NO: 33 | 4294 |
| INFL158 | Heavy chain | | US20140205614, US20100316654 SEQ ID NO: 34 | 4295 |
| INFL159 | Heavy chain | | US20140205614, US20100316654 SEQ ID NO: 35 | 4296 |
| INFL160 | Heavy chain | | US20140205614, US20100316654 SEQ ID NO: 36 | 4297 |
| INFL161 | Heavy chain | | US20140205614, US20100316654 SEQ ID NO: 37 | 4298 |
| INFL162 | Heavy chain | | US20140205614, US20100316654 SEQ ID NO: 38 | 4299 |
| INFL163 | Heavy chain | | US20140205614, US20100316654 SEQ ID NO: 39 | 4300 |
| INFL164 | Heavy chain | | US20140205614, US20100316654 SEQ ID NO: 40 | 4301 |
| INFL165 | Heavy chain | | US20140205614, US20100316654 SEQ ID NO: 41 | 4302 |
| INFL166 | Heavy chain | | US20140205614, US20100316654 SEQ ID NO: 42 | 4303 |
| INFL167 | Heavy chain | | US20140205614, US20100316654 SEQ ID NO: 43 | 4304 |

TABLE 21-continued

Antibodies against Influenza virus

| Antibody No. | Description | Antibody Name | Reference Information | SEQ ID NO |
|---|---|---|---|---|
| INFL168 | Heavy chain | | US20140205614, US20100316654 SEQ ID NO: 44 | 4305 |
| INFL169 | Heavy chain | | US20140205614, US20100316654 SEQ ID NO: 45 | 4306 |
| INFL170 | Heavy chain | mAb1 | WO2015112994 SEQ ID NO: 76 | 4307 |
| INFL171 | Heavy chain | CR8033 | Dreyfus, C., Laursen, N. S. et al., Highly conserved protective epitopes on influenza B viruses; Science 337 (6100), 1343-1348 (2012), NCBI Accession # 4FQL_H | 4308 |
| INFL172 | Heavy chain (Partial) | monoclonal antibody PN-SIA28 | Burioni, R. et al., Monoclonal antibodies isolated from human B cells neutralize a broad range of H1 subtype influenza A viruses including swine-origin Influenza virus(S-OIV); Virology (2010), NCBI Accession #ACX30936.1 (122aa) | 4309 |
| INFL173 | Heavy chain (Partial) | monoclonal antibody PN-SIA49 | Burioni, R, et al., Monoclonal antibodies isolated from human B cells neutralize a broad range of H1 subtype influenza A viruses including swine-origin Influenza virus(S-OIV); Virology (2010), NCBI Accession #ACX30937.1 (127aa) | 4310 |
| INFL174 | Heavy chain cdr1 | Ab1A2 | WO2015028478 SEQ ID 6 | 4311 |
| INFL175 | Heavy chain cdr2 | Ab1A2 | WO2015028478 SEQ ID 7 | 4312 |
| INFL176 | Heavy chain cdr3 | Ab1A2 | WO2015028478 SEQ ID 8 | 4313 |
| INFL177 | Heavy chain constant region, Human igg1 | | U.S. Pat. No. 8,992,929 SEQ ID NO. 22 | 4314 |
| INFL178 | Heavy chain Fab | CT147 | WO2013048153, US20140234336 SEQ ID NO: 38 | 4315 |
| INFL179 | Heavy chain Fab | CT164 | WO2013048153, US20140234336 SEQ ID NO: 42 | 4316 |
| INFL180 | Heavy chain Fab | CT166 | WO2013048153, US20140234336 SEQ ID NO: 44 | 4317 |
| INFL181 | Heavy chain G2 | h2B9 | U.S. Pat. No. 9,115,201 SEQ ID NO: 7 | 4318 |
| INFL182 | Heavy chain G5 | h2B10 | U.S. Pat. No. 9,115,201 SEQ ID NO: 8 | 4319 |
| INFL183 | Heavy chain variable (exemplary) | HC-VD from US2013030234 | US2013030234 SEQ ID NO: 1 | 4320 |
| INFL184 | Heavy chain variable (exemplary) | HC-VD from US2013030234 | US2013030234 SEQ ID NO: 2 | 4321 |
| INFL185 | Heavy chain variable (exemplary) | HC-VD from US2013030234 | US2013030234 SEQ ID NO: 3 | 4322 |
| INFL186 | Heavy chain variable (exemplary) | HC-VD from US2013030234 | US2013030234 SEQ ID NO: 4 | 4323 |
| INFL187 | Heavy chain variable (exemplary) | HC-VD from US2013030234 | US2013030234 SEQ ID NO: 5 | 4324 |
| INFL188 | Heavy chain variable (exemplary) | HC-VD from US2013030234 | US2013030234 SEQ ID NO: 6 | 4325 |
| INFL189 | Heavy chain variable (exemplary) | HC-VD from US2013030234 | US2013030234 SEQ ID NO: 7 | 4326 |
| INFL190 | Heavy chain variable (exemplary) | HC-VD from US2013030234 | US2013030234 SEQ ID NO: 8 | 4327 |
| INFL191 | Heavy chain variable (exemplary) | HC-VD from US2013030234 | US2013030234 SEQ ID NO: 9 | 4328 |
| INFL192 | Heavy chain variable (exemplary) | HC-VD from US2013030234 | US2013030234 SEQ ID NO: 10 | 4329 |
| INFL193 | Heavy chain variable (exemplary) | HC-VD from US2013030234 | US2013030234 SEQ ID NO: 11 | 4330 |
| INFL194 | Heavy chain variable (exemplary) | HC-VD from US2013030234 | US2013030234 SEQ ID NO: 12 | 4331 |
| INFL195 | Heavy chain variable (exemplary) | HC-VD from US2013030234 | US2013030234 SEQ ID NO: 13 | 4332 |
| INFL196 | Heavy chain variable (exemplary) | HC-VD from US2013030234 | US2013030234 SEQ ID NO: 14 | 4333 |
| INFL197 | Heavy chain variable (exemplary) | HC-VD from US2013030234 | US2013030234 SEQ ID NO: 15 | 4334 |
| INFL198 | Heavy chain variable (exemplary) | HC-VD from US2013030234 | US2013030234 SEQ ID NO: 16 | 4335 |
| INFL199 | Heavy chain variable region | CR6141 | US20150104459 SEQ ID NO: 199 | 4336 |
| INFL200 | Heavy chain variable region | 39.18 B11 | US20140161822 SEQ ID NO: 154 | 4337 |
| INFL201 | Heavy chain variable region | 39.18 E12 | US20140161822 SEQ ID NO: 158 | 4338 |

TABLE 21-continued

Antibodies against Influenza virus

| Antibody No. | Description | Antibody Name | Reference Information | SEQ ID NO |
|---|---|---|---|---|
| INFL202 | Heavy chain variable region | GG3 | WO2014159960 SEQ ID NO: 17 | 4339 |
| INFL203 | Heavy chain variable region | N547 | U.S. Pat. No. 8,003,106 SEQ ID NO: 28 | 4340 |
| INFL204 | Heavy chain variable region | L66 | U.S. Pat. No. 8,003,106 SEQ ID NO: 30 | 4341 |
| INFL205 | Heavy chain variable region | C40 | U.S. Pat. No. 8,003,106 SEQ ID NO: 26 | 4342 |
| INFL206 | Heavy chain variable region | 14C2 | U.S. Pat. No. 8,080,244 SEQ ID NO: 6 | 4343 |
| INFL207 | Heavy chain variable region | h14C2 | U.S. Pat. No. 8,080,244 SEQ ID NO: 2 | 4344 |
| INFL208 | Heavy chain variable region | 8G9 | U.S. Pat. No. 8,603,467 SEQ ID NO: 2 | 4345 |
| INFL209 | Heavy chain variable region | 13D4 | U.S. Pat. No. 8,603,467 SEQ ID NO: 6 | 4346 |
| INFL210 | Heavy chain variable region | 20A11 | U.S. Pat. No. 8,603,467 SEQ ID NO: 10 | 4347 |
| INFL211 | Heavy chain variable region | VN04-2-HuG1 | US20100150941 SEQ ID NO: 5 | 4348 |
| INFL212 | Heavy chain variable region | VN04-3-HuG1 | US20100150941 SEQ ID NO: 7 | 4349 |
| INFL213 | Heavy chain variable region | FI6 variant 1 | U.S. Pat. No. 8,871,207 SEQ ID NO: 13 | 4350 |
| INFL214 | Heavy chain variable region | FI6 variant 2 | U.S. Pat. No. 8,871,207 SEQ ID NO: 33 | 4351 |
| INFL215 | Heavy chain variable region | FI6 variant 3 | U.S. Pat. No. 8,871,207 SEQ ID NO: 55 | 4352 |
| INFL216 | Heavy chain variable region | FI6 variant 4, FI6 variant 5 | U.S. Pat. No. 8,871,207 SEQ ID NO: 59 | 4353 |
| INFL217 | Heavy chain variable region | FI28 variant 1 | U.S. Pat. No. 8,871,207 SEQ ID NO: 29 | 4354 |
| INFL218 | Heavy chain variable region | FI28 variant 2 | U.S. Pat. No. 8,871,207 SEQ ID NO: 35 | 4355 |
| INFL219 | Heavy chain variable region | 21B15 | U.S. Pat. No. 8,858,948 SEQ ID NO: 44 | 4356 |
| INFL220 | Heavy chain variable region | 3241_G23 | U.S. Pat. No. 8,858,948 SEQ ID NO: 116 | 4357 |
| INFL221 | Heavy chain variable region | 3244_I10 | U.S. Pat. No. 8,858,948 SEQ ID NO: 120 | 4358 |
| INFL222 | Heavy chain variable region | 3243_J07 | U.S. Pat. No. 8,858,948 SEQ ID NO: 124 | 4359 |
| INFL223 | Heavy chain variable region | 3259_J21 | U.S. Pat. No. 8,858,948 SEQ ID NO: 128 | 4360 |
| INFL224 | Heavy chain variable region | 3245_O19 | U.S. Pat. No. 8,858,948 SEQ ID NO: 132 | 4361 |
| INFL225 | Heavy chain variable region | 3244_H04 | U.S. Pat. No. 8,858,948 SEQ ID NO: 136 | 4362 |
| INFL226 | Heavy chain variable region | 3136_G05 | U.S. Pat. No. 8,858,948 SEQ ID NO: 140 | 4363 |
| INFL227 | Heavy chain variable region | 3252_C13 | U.S. Pat. No. 8,858,948 SEQ ID NO: 144 | 4364 |
| INFL228 | Heavy chain variable region | 3255_J06 | U.S. Pat. No. 8,858,948 SEQ ID NO: 148 | 4365 |
| INFL229 | Heavy chain variable region | 3420_I23 | U.S. Pat. No. 8,858,948 SEQ ID NO: 152 | 4366 |
| INFL230 | Heavy chain variable region | 3139_P23 | U.S. Pat. No. 8,858,948 SEQ ID NO: 156 | 4367 |
| INFL231 | Heavy chain variable region | 3139_P23 | U.S. Pat. No. 8,858,948 SEQ ID NO: 158 | 4368 |
| INFL232 | Heavy chain variable region | 3248_P18 | U.S. Pat. No. 8,858,948 SEQ ID NO: 162 | 4369 |
| INFL233 | Heavy chain variable region | 3253_P10 | U.S. Pat. No. 8,858,948 SEQ ID NO: 166 | 4370 |
| INFL234 | Heavy chain variable region | 3260_D19 | U.S. Pat. No. 8,858,948 SEQ ID NO: 170 | 4371 |
| INFL235 | Heavy chain variable region | 3362_B11 | U.S. Pat. No. 8,858,948 SEQ ID NO: 172 | 4372 |
| INFL236 | Heavy chain variable region | 3242_P05 | U.S. Pat. No. 8,858,948 SEQ ID NO: 176 | 4373 |
| INFL237 | Heavy chain variable region | 2K11 | Krause, J. C. et al. "Epitope-specific human influenza antibody repertoires diversify by B cell intraclonal sequence divergence and interclonal convergence" | 4374 |

TABLE 21-continued

Antibodies against Influenza virus

| Antibody No. | Description | Antibody Name | Reference Information | SEQ ID NO |
|---|---|---|---|---|
| INFL238 | Heavy chain variable region | 2O10 | J. Immunol. 187 (7), 3704-3711 (2011), NCBI Accession #AEO16793 Krause, J. C. et al. "Epitope-specific human influenza antibody repertoires diversify by B cell intraclonal sequence divergence and interclonal convergence" | 4375 |
| INFL239 | Heavy chain variable region | 4K8 | J. Immunol. 187 (7), 3704-3711 (2011), NCBI Accession #AEO16795 Krause, J. C. et al. "Epitope-specific human influenza antibody repertoires diversify by B cell intraclonal sequence divergence and interclonal convergence" | 4376 |
| INFL240 | Heavy chain variable region | 6D9 | J. Immunol. 187 (7), 3704-3711 (2011), NCBI Accession #AEO16799 Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16801 | 4377 |
| INFL241 | Heavy chain variable region | 4D20 | Yu, X. et al "Neutralizing antibodies derived from the B cells of 1918 influenza pandemic survivors", Nature 455 (7212), 532-536, NCBI Accession #ACI04579 | 4378 |
| INFL242 | Heavy chain variable region | 2B12 | Yu, X. et al "Neutralizing antibodies derived from the B cells of 1918 influenza pandemic survivors", Nature 455 (7212), 532-536, NCBI Accession #ABY48866 | 4379 |
| INFL243 | Heavy chain variable region | 8D4 | NCBI Accession #AFI57036 | 4380 |
| INFL244 | Heavy chain variable region | 5B6 | NCBI Accession #AFI57040 | 4381 |
| INFL245 | Heavy chain variable region | A66 | WO2009079259, US20110038935, US20140011982 SEQ ID NO: 32 | 4382 |
| INFL246 | Heavy chain variable region | D7 | WO2009079259, US20110038935, US20140011982 SEQ ID NO: 6 | 4383 |
| INFL247 | Heavy chain variable region | D8, D80 | WO2009079259, US20110038935, US20140011982 SEQ ID NO: 12 | 4384 |
| INFL248 | Heavy chain variable region | E88 | WO2009079259, US20110038935, US20140011982 SEQ ID NO: 36 | 4385 |
| INFL249 | Heavy chain variable region | E90, F10 | WO2009079259, US20110038935, US20140011982 SEQ ID NO: 18 | 4386 |
| INFL250 | Heavy chain variable region | F10 | WO2009079259, US20110038935, US20140011982 SEQ ID NO: 112 | 4387 |
| INFL251 | Heavy chain variable region | G17 | WO2009079259, US20110038935, US20140011982 SEQ ID NO: 24 | 4388 |
| INFL252 | Heavy chain variable region | H40 | WO2009079259, US20110038935, US20140011982 SEQ ID NO: 28 | 4389 |
| INFL253 | Heavy chain variable region | CH65 | WO2013020074, US20140302043 SEQ ID NO: 14 | 4390 |
| INFL254 | Heavy chain variable region | CH66 | WO2013020074, US20140302043 SEQ ID NO: 15 | 4391 |
| INFL255 | Heavy chain variable region | CH67 | WO2013020074, US20140302043 SEQ ID NO: 16 | 4392 |
| INFL256 | Heavy chain variable region | CL86OUCA | WO2013020074, US20140302043 SEQ ID NO: 13 | 4393 |
| INFL257 | Heavy chain variable region | Antibody 1 | WO2015051010 SEQ ID NO: 2 | 4394 |
| INFL258 | Heavy chain variable region | Antibody 2 | WO2015051010 SEQ ID NO: 12 | 4395 |
| INFL259 | Heavy chain variable region | Antibody 3 | WO2015051010 SEQ ID NO: 22 | 4396 |
| INFL260 | Heavy chain variable region | Antibody 4 | WO2015051010 SEQ ID NO: 32 | 4397 |
| INFL261 | Heavy chain variable region | Antibody 5 | WO2015051010 SEQ ID NO: 42 | 4398 |
| INFL262 | Heavy chain variable region | Antibody 6 | WO2015051010 SEQ ID NO: 52 | 4399 |
| INFL263 | Heavy chain variable region | Antibody 7 | WO2015051010 SEQ ID NO: 62 | 4400 |
| INFL264 | Heavy chain variable region | Antibody 8 | WO2015051010 SEQ ID NO: 72 | 4401 |

TABLE 21-continued

Antibodies against Influenza virus

| Antibody No. | Description | Antibody Name | Reference Information | SEQ ID NO |
|---|---|---|---|---|
| INFL265 | Heavy chain variable region | Antibody 9 | WO2015051010 SEQ ID NO: 82 | 4402 |
| INFL266 | Heavy chain variable region | Antibody 10 | WO2015051010 SEQ ID NO: 92 | 4403 |
| INFL267 | Heavy chain variable region | Antibody 11 | WO2015051010 SEQ ID NO: 102 | 4404 |
| INFL268 | Heavy chain variable region | Antibody 12 | WO2015051010 SEQ ID NO: 112 | 4405 |
| INFL269 | Heavy chain variable region | Antibody 13 | WO2015051010 SEQ ID NO: 122 | 4406 |
| INFL270 | Heavy chain variable region | Antibody 14 | WO2015051010 SEQ ID NO: 132 | 4407 |
| INFL271 | Heavy chain variable region | Antibody 15 | WO201505I010 SEQ ID NO: 142 | 4408 |
| INFL272 | Heavy chain variable region | Antibody 3-GL | WO2015051010 SEQ ID NO: 152 | 4409 |
| INFL273 | Heavy chain variable region | EM4C04 | US20120282273 SEQ ID NO: 2 | 4410 |
| INFL274 | Heavy chain variable region | 005-2G02 | WO2013059524, US20140348851 SEQ ID NO: 1 | 4411 |
| INFL275 | Heavy chain variable region | 005-2G02 | WO2013059524, US20140348851 SEQ ID NO: 9 | 4412 |
| INFL276 | Heavy chain variable region | 09-2A06 | WO2013059524, US20140348851 SEQ ID NO: 21 | 4413 |
| INFL277 | Heavy chain variable region | 09-2A06 | WO2013059524, US20140348851 SEQ ID NO: 29 | 4414 |
| INFL278 | Heavy chain variable region | 09-3A01 | WO2013059524, US20140348851 SEQ ID NO: 41 | 4415 |
| INFL279 | Heavy chain variable region | 09-3A01 | WO2013059524, US20140348851 SEQ ID NO: 49 | 4416 |
| INFL280 | Heavy chain variable region | 70-IF02 | WO2012096994, US20140046039 SEQ ID NO: 18 | 4417 |
| INFL281 | Heavy chain variable region | | US20120058124 SEQ ID NO: 10 | 4418 |
| INFL282 | Heavy chain variable region | | US20120058124 SEQ ID NO: 11 | 4419 |
| INFL283 | Heavy chain variable region | | US20120058124 SEQ ID NO: 12 | 4420 |
| INFL284 | Heavy chain variable region | | US20120058124 SEQ ID NO: 13 | 4421 |
| INFL285 | Heavy chain variable region | | US20120058124 SEQ ID NO: 14 | 4422 |
| INFL286 | Heavy chain variable region | 81.39 | US20140161822, US20140248286, WO2014078268 SEQ ID NO: 111 | 4423 |
| INFL287 | Heavy chain variable region | 81.39 | US20140161822, US20140248286, WO2014078268 SEQ ID NO: 115 | 4424 |
| INFL288 | Heavy chain variable region | 39.29 | US20140161822, US20140248286, WO2014078268 SEQ ID NO: 134 | 4425 |
| INFL289 | Heavy chain variable region | 39.29 | US20140161822, US20140248286, WO2014078268 SEQ ID NO: 138 | 4426 |
| INFL290 | Heavy chain variable region | 39.29 | US20140161822, US20140248286, WO2014078268 SEQ ID NO: 142 | 4427 |
| INFL291 | Heavy chain variable region | 39.29 | US20140161822, US20140248286, WO2014078268 SEQ ID NO: 148 | 4428 |
| INFL292 | Heavy chain variable region | 36.89 | US20140161822, US20140248286, WO2014078268 SEQ ID NO: 160 | 4429 |
| INFL293 | Heavy chain variable region | 9.01F3 | US20140161822, US20140248286, WO2014078268 SEQ ID NO: 164 | 4430 |
| INFL294 | Heavy chain variable region | 23.06C2 | US20140161822, US20140248286, WO2014078268 SEQ ID NO: 168 | 4431 |
| INFL295 | Heavy chain variable region | 39.29 | US20140161822, US20140248286, WO2014078268 SEQ ID NO: 234 | 4432 |
| INFL296 | Heavy chain variable region | F16 Variant 5 | WO2013011347, US20140271655, US8871207 SEQ ID NO: 59 | 4433 |
| INFL297 | Heavy chain variable region | F16 Variant 3 | WO2013011347, US20140271655, US8871207 SEQ ID NO: 55 | 4434 |
| INFL298 | Heavy chain variable region | F16 Variant 2 | WO2010010466 SEQ ID NO: 33 | 4435 |
| INFL299 | Heavy chain variable region | FC41 | WO2010010467 SEQ ID NO 60 | 4436 |
| INFL300 | Heavy chain variable region | FE43 | WO2010010467 SEQ ID NO 74 | 4437 |
| INFL301 | Heavy chain variable region | FB75, FB110, FB177 | WO2010010467 SEQ ID NO 121 | 4438 |

TABLE 21-continued

Antibodies against Influenza virus

| Antibody No. | Description | Antibody Name | Reference Information | SEQ ID NO |
|---|---|---|---|---|
| INFL302 | Heavy chain variable region | FE17 | WO2010010467 SEQ ID NO 105 | 4439 |
| INFL303 | Heavy chain variable region | FB79 | WO2010010467 SEQ ID NO 131 | 4440 |
| INFL304 | Heavy chain variable region | FC1C | WO2010010467 SEQ ID NO 139 | 4441 |
| INFL305 | Heavy chain variable region | FC6 | WO2010010467 SEQ ID NO 45 | 4442 |
| INFL306 | Heavy chain variable region | FE53 | WO2010010467 SEQ ID NO 89 | 4443 |
| INFL307 | Heavy chain variable region | 7A7 | WO2010138564 SEQ ID NO: 6 | 4444 |
| INFL308 | Heavy chain variable region | 12DI | WO2010138564 SEQ ID NO: 12 | 4445 |
| INFL309 | Heavy chain variable region | 66A6 | WO2010138564 SEQ ID NO: 16 | 4446 |
| INFL310 | Heavy chain variable region | B-1 | U.S. Pat. No. 8,975,378, US20110319600, WO2010073647 SEQ ID NO: 27 | 4447 |
| INFL311 | Heavy chain variable region | D1 | U.S. Pat. No. 8,975,378, US20110319600, WO2010073647 SEQ ID NO: 29 | 4448 |
| INFL312 | Heavy chain variable region | E-2 | U.S. Pat. No. 8,975,378, US20110319600, WO2010073647 SEQ ID NO: 31 | 4449 |
| INFL313 | Heavy chain variable region | B-3 | U.S. Pat. No. 8,975,378, US20110319600, WO2010073647 SEQ ID NO: 33 | 4450 |
| INFL314 | Heavy chain variable region | 5A7 | WO2013114885, US20140377262 SEQ ID NO: 33 | 4451 |
| INFL315 | Heavy chain variable region | 3A2 | WO2013114885, US20140377262 SEQ ID NO: 37 | 4452 |
| INFL316 | Heavy chain variable region | 10C4 | WO2013114885, US20140377262 SEQ ID NO: 41 | 4453 |
| INFL317 | Heavy chain variable region | Fab49 | WO2009144667, US20110076265 SEQ ID NO: 1 | 4454 |
| INFL318 | Heavy chain variable region | Fab28 IgG PN-SIA28 | WO2009115972, WO2011117848, US20110014187 SEQ ID NO: 1 | 4455 |
| INFL319 | Heavy chain variable region | TCN-522 | US20120207760, U.S. Pat. No. 8,916,160 SEQ ID NO: 771; U.S. Pat. No. 8,900,590 SEQ ID NO: 32 | 4456 |
| INFL320 | Heavy chain variable region | CR8019 | WO2010130636 SEQ ID NO: 26 | 4457 |
| INFL321 | Heavy chain variable region | CR8020 | WO2010130636 SEQ ID NO: 30 | 4458 |
| INFL322 | Heavy chain variable region | CR8021 | WO2010130636 SEQ ID NO: 34 | 4459 |
| INFL323 | Heavy chain variable region | CR8038 | WO2010130636 SEQ ID NO: 38 | 4460 |
| INFL324 | Heavy chain variable region | CR8039 | WO2010130636 SEQ ID NO: 42 | 4461 |
| INFL325 | Heavy chain variable region | CR8040 | WO2010130636 SEQ ID NO: 46 | 4462 |
| INFL326 | Heavy chain variable region | CR8041 | WO2010130636 SEQ ID NO: 50 | 4463 |
| INFL327 | Heavy chain variable region | CR8043 | WO2010130636 SEQ ID NO: 54 | 4464 |
| INFL328 | Heavy chain variable region | CR8049 | WO2010130636 SEQ ID NO: 58 | 4465 |
| INFL329 | Heavy chain variable region | CR8050 | WO2010130636 SEQ ID NO: 61 | 4466 |
| INFL330 | Heavy chain variable region | CR8052 | WO2010130636 SEQ ID NO: 65 | 4467 |
| INFL331 | Heavy chain variable region | CR8055 | WO2010130636 SEQ ID NO: 69 | 4468 |
| INFL332 | Heavy chain variable region | CR8057 | WO2010130636 SEQ ID NO: 73 | 4469 |
| INFL333 | Heavy chain variable region | CR8069 | WO2010130636 SEQ ID NO: 77 | 4470 |
| INFL334 | Heavy chain variable region | CR6255 | US20090311265, U.S. Pat. No. 8,691,223, U.S. Pat. No. 9,109,017, WO2008028946A SEQ ID NO: 59 | 4471 |
| INFL335 | Heavy chain variable region | CR6257 | US20090311265, U.S. Pat. No. 8,691,223, U.S. Pat. No. 9,109,017, WO2008028946 SEQ ID NO: 61 | 4472 |
| INFL336 | Heavy chain variable region | CR6260 | US20090311265, U.S. Pat. No. 8,691,223, U.S. Pat. No. 9,109,017, WO2008028946 SEQ ID NO: 63 | 4473 |

TABLE 21-continued

Antibodies against Influenza virus

| Antibody No. | Description | Antibody Name | Reference Information | SEQ ID NO |
|---|---|---|---|---|
| INFL337 | Heavy chain variable region | CR6261 | US20090311265, U.S. Pat. No. 8,691,223, U.S. Pat. No. 9,109,017, WO2008028946 SEQ ID NO: 65 | 4474 |
| INFL338 | Heavy chain variable region | CR6262 | US20090311265, U.S. Pat. No. 8,691,223, U.S. Pat. No. 9,109,017, WO2008028946 SEQ ID NO: 67 | 4475 |
| INFL339 | Heavy chain variable region | CR6268 | US20090311265, U.S. Pat. No. 8,691,223, U.S. Pat. No. 9,109,017, WO2008028946 SEQ ID NO: 69 | 4476 |
| INFL340 | Heavy chain variable region | CR6307 | US20090311265, U.S. Pat. No. 8,691,223, U.S. Pat. No. 9,109,017, WO2008028946 SEQ ID NO: 71 | 4477 |
| INFL341 | Heavy chain variable region | CR6310 | US20090311265, U.S. Pat. No. 8,691,223, U.S. Pat. No. 9,109,017, WO2008028946 SEQ ID NO: 73 | 4478 |
| INFL342 | Heavy chain variable region | CR6314 | US20090311265, U.S. Pat. No. 8,691,223, U.S. Pat. No. 9,109,017, WO2008028946 SEQ ID NO: 75 | 4479 |
| INFL343 | Heavy chain variable region | CR6323 | US20090311265, U.S. Pat. No. 8,691,223, U.S. Pat. No. 9,109,017, WO2008028946 SEQ ID NO: 77 | 4480 |
| INFL344 | Heavy chain variable region | CR6325 | US20090311265, U.S. Pat. No. 8,691,223, U.S. Pat. No. 9,109,017, WO2008028946 SEQ ID NO: 79 | 4481 |
| INFL345 | Heavy chain variable region | CR6331 | US20090311265, U.S. Pat. No. 8,691,223, U.S. Pat. No. 9,109,017, WO2008028946 SEQ ID NO: 81 | 4482 |
| INFL346 | Heavy chain variable region | CR6344 | US20090311265, U.S. Pat. No. 8,691,223, U.S. Pat. No. 9,109,017, WO2008028946 SEQ ID NO: 83 | 4483 |
| INFL347 | Heavy chain variable region | CR6141 | US20090311265, U.S. Pat. No. 8,691,223, U.S. Pat. No. 9,109,017, WO2008028946 SEQ ID NO: 317 | 4484 |
| INFL348 | Heavy chain variable region | CR6272 | US20090311265, U.S. Pat. No. 8,691,223, U.S. Pat. No. 9,109,017, WO2008028946 SEQ ID NO: 321 | 4485 |
| INFL349 | Heavy chain variable region | CR6296 | US20090311265, U.S. Pat. No. 8,691,223, U.S. Pat. No. 9,109,017, WO2008028946 SEQ ID NO: 325 | 4486 |
| INFL350 | Heavy chain variable region | CR6301 | US20090311265, U.S. Pat. No. 8,691,223, U.S. Pat. No. 9,109,017, WO2008028946 SEQ ID NO: 329 | 4487 |
| INFL351 | Heavy chain variable region | CR6327 | US20090311265, U.S. Pat. No. 8,691,223, U.S. Pat. No. 9,109,017, WO2008028946 SEQ ID NO: 333 | 4488 |
| INFL352 | Heavy chain variable region | CR6328 | US20090311265, U.S. Pat. No. 8,691,223, U.S. Pat. No. 9,109,017, WO2008028946 SEQ ID NO: 337 | 4489 |
| INFL353 | Heavy chain variable region | CR6329 | US20090311265, U.S. Pat. No. 8,691,223, U.S. Pat. No. 9,109,017, WO2008028946 SEQ ID NO: 341 | 4490 |
| INFL354 | Heavy chain variable region | CR6332 | US20090311265, U.S. Pat. No. 8,691,223, U.S. Pat. No. 9,109,017, WO2008028946 SEQ ID NO: 345 | 4491 |
| INFL355 | Heavy chain variable region | CR6334 | US20090311265, U.S. Pat. No. 8,691,223, U.S. Pat. No. 9,109,017, WO2008028946 SEQ ID NO: 349 | 4492 |
| INFL356 | Heavy chain variable region | CR6336 | US20090311265, U.S. Pat. No. 8,691,223, U.S. Pat. No. 9,109,017, WO2008028946 SEQ ID NO: 353 | 4493 |
| INFL357 | Heavy chain variable region | CR6339 | US20090311265, U.S. Pat. No. 8,691,223, U.S. Pat. No. 9,109,017, WO2008028946 SEQ ID NO: 357 | 4494 |
| INFL358 | Heavy chain variable region | CR6342 | US20090311265, U.S. Pat. No. 8,691,223, U.S. Pat. No. 9,109,017, WO2008028946 SEQ ID NO: 361 | 4495 |
| INFL359 | Heavy chain variable region | CR6343 | US20090311265, U.S. Pat. No. 8,691,223, U.S. Pat. No. 9,109,017, WO2008028946 SEQ ID NO: 365 | 4496 |
| INFL360 | Heavy chain variable region | CR9003 | US20140120113 SEQ ID NO: 2 | 4497 |
| INFL361 | Heavy chain variable region | CR9004 | US20140120113 SEQ ID NO: 6 | 4498 |

TABLE 21-continued

Antibodies against Influenza virus

| Antibody No. | Description | Antibody Name | Reference Information | SEQ ID NO |
|---|---|---|---|---|
| INFL362 | Heavy chain variable region | CR9005 | US20140120113 SEQ ID NO: 10 | 4499 |
| INFL363 | Heavy chain variable region | CR9006 | US20140120113 SEQ ID NO: 14 | 4500 |
| INFL364 | Heavy chain variable region | CR9007 | US20140120113 SEQ ID NO: 18 | 4501 |
| INFL365 | Heavy chain variable region | CR9008 | US20140120113 SEQ ID NO: 22 | 4502 |
| INFL366 | Heavy chain variable region | CR9009 | US20140120113 SEQ ID NO: 26 | 4503 |
| INFL367 | Heavy chain variable region | CR9010 | US20140120113 SEQ ID NO: 30 | 4504 |
| INFL368 | Heavy chain variable region | CR9011 | US20140120113 SEQ ID NO: 34 | 4505 |
| INFL369 | Heavy chain variable region | CR9012 | US20140120113 SEQ ID NO: 38 | 4506 |
| INFL370 | Heavy chain variable region | CR9029 | US20140120113 SEQ ID NO: 42 | 4507 |
| INFL371 | Heavy chain variable region | CR9030 | US20140120113 SEQ ID NO: 46 | 4508 |
| INFL372 | Heavy chain variable region | CR9031 | US20140120113 SEQ ID NO: 50 | 4509 |
| INFL373 | Heavy chain variable region | CR9112 | US20140120113 SEQ ID NO: 54 | 4510 |
| INFL374 | Heavy chain variable region | CR9113 | US20140120113 SEQ ID NO: 58 | 4511 |
| INFL375 | Heavy chain variable region | CR9114 | US20140120113 SEQ ID NO: 62 | 4512 |
| INFL376 | Heavy chain variable region | CR8033 | U.S. Pat. No. 8,852,595 SEQ ID NO: 71 | 4513 |
| INFL377 | Heavy chain variable region | CR8059 | U.S. Pat. No. 8,852,595 SEQ ID NO: 75 | 4514 |
| INFL378 | Heavy chain variable region | CR8071 | U.S. Pat. No. 8,852,595 SEQ ID NO: 78 | 4515 |
| INFL379 | Heavy chain variable region | CR10051 | U.S. Pat. No. 8,852,595 SEQ ID NO: 81 | 4516 |
| INFL380 | Heavy chain variable region | CR10049 | U.S. Pat. No. 8,852,595 SEQ ID NO: 85 | 4517 |
| INFL381 | Heavy chain variable region | CR10023 | U.S. Pat. No. 8,852,595 SEQ ID NO: 89 | 4518 |
| INFL382 | Heavy chain variable region | CR10032 | U.S. Pat. No. 8,852,595 SEQ ID NO: 93 | 4519 |
| INFL383 | Heavy chain variable region | CR11035 | U.S. Pat. No. 8,852,595 SEQ ID NO: 101 | 4520 |
| INFL384 | Heavy chain variable region | CR11036 | U.S. Pat. No. 8,852,595 SEQ ID NO: 105 | 4521 |
| INFL385 | Heavy chain variable region | CR11038 | U.S. Pat. No. 8,852,595 SEQ ID NO: 109 | 4522 |
| INFL386 | Heavy chain variable region | CR11039 | U.S. Pat. No. 8,852,595 SEQ ID NO: 113 | 4523 |
| INFL387 | Heavy chain variable region | CR8031 | U.S. Pat. No. 8,852,595 SEQ ID NO: 119 | 4524 |
| INFL388 | Heavy chain variable region | CR8032 | U.S. Pat. No. 8,852,595 SEQ ID NO: 123 | 4525 |
| INFL389 | Heavy chain variable region | CR8034 | U.S. Pat. No. 8,852,595 SEQ ID NO: 127 | 4526 |
| INFL390 | Heavy chain variable region | CR8035 | U.S. Pat. No. 8,852,595 SEQ ID NO: 131 | 4527 |
| INFL391 | Heavy chain variable region | | U.S. Pat. No. 8,992,929 SEQ ID NO: 4 | 4528 |
| INFL392 | Heavy chain variable region | M2e | U.S. Pat. No. 8,420,794 SEQ ID NO: 2 | 4529 |
| INFL393 | Heavy chain variable region | | U.S. Pat. No. 8,715,743, US20140275492 SEQ ID NO: 22 | 4530 |
| INFL394 | Heavy chain variable region | | U.S. Pat. No. 8,715,743, US20140275492 SEQ ID NO: 25 | 4531 |
| INFL395 | Heavy chain variable region | | U.S. Pat. No. 8,715,743, US20140275492 SEQ ID NO: 36 | 4532 |
| INFL396 | Heavy chain variable region | 4A10 | Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16797 | 4533 |

TABLE 21-continued

Antibodies against Influenza virus

| Antibody No. | Description | Antibody Name | Reference Information | SEQ ID NO |
|---|---|---|---|---|
| INFL397 | Heavy chain variable region | anti-1918 influenza HA Ig | Yu, X., et al., Neutralizing antibodies derived front the B cells of 1918 influenza pandemic survivors; Nature 455 (7212), 532-536 (2008), NCBI Accession #ACI04579.1 (129aa) | 4534 |
| INFL398 | Heavy chain variable region | TCN-522 (3212_I12) | US20150086555 SEQ ID NO: 33 | 4535 |
| INFL399 | Heavy chain variable region | TCN-521 (3280_D18) | US20150086555 SEQ ID NO: 21 | 4536 |
| INFL400 | Heavy chain variable region | TCN-523 (5248_A17) | US20150086555 SEQ ID NO: 45 | 4537 |
| INFL401 | Heavy chain variable region | TCN-563 (5237_B21) | US20150086555 SEQ ID NO: 57 | 4538 |
| INFL402 | Heavy chain variable region | TCN-526 (5084_C17) | US20150086555 SEQ ID NO: 69 | 4539 |
| INFL403 | Heavy chain variable region | TCN-527 (5086_C06) | US20150086555 SEQ ID NO: 81 | 4540 |
| INFL404 | Heavy chain variable region | TCN-528 (5087_P17) | US20150086555 SEQ ID NO: 93 | 4541 |
| INFL405 | Heavy chain variable region | TCN-529 (5297_H01) | US20150086555 SEQ ID NO: 105 | 4542 |
| INFL406 | Heavy chain variable region | TCN-530 (5248_H10) | US20150086555 SEQ ID NO: 117 | 4543 |
| INFL407 | Heavy chain variable region | TCN-531 (5091_H13) | US20150086555 SEQ ID NO: 129 | 4544 |
| INFL408 | Heavy chain variable region | TCN-532 (5262_H18) | US20150086555 SEQ ID NO: 141 | 4545 |
| INFL409 | Heavy chain variable region | TCN-533 (5256_A17a), TCN-564 (5256_A17b) | US20150086555 SEQ ID NO: 153 | 4546 |
| INFL410 | Heavy chain variable region | TCN-534 (5249_B02) | US20150086555 SEQ ID NO: 161 | 4547 |
| INFL411 | Heavy chain variable region | TCN-535 (5246_P19), TCN-558 (5248_H10b) | US20150086555 SEQ ID NO: 173 | 4548 |
| INFL412 | Heavy chain variable region | TCN-536 (5095_N01) | US20150086555 SEQ ID NO: 184 | 4549 |
| INFL413 | Heavy chain variable region | TCN-537 (3194_D21) | US20150086555 SEQ ID NO: 195 | 4550 |
| INFL414 | Heavy chain variable region | TCN-538 (3206_O17) | US20150086555 SEQ ID NO: 207 | 4551 |
| INFL415 | Heavy chain variable region | TCN-539 (5056_A08) | US20150086555 SEQ ID NO: 219 | 4552 |
| INFL416 | Heavy chain variable region | TCN-540 (5060_F05) | US20150086555 SEQ ID NO: 231 | 4553 |
| INFL417 | Heavy chain variable region | TCN-541 (5062_M11) | US20150086555 SEQ ID NO: 243 | 4554 |
| INFL418 | Heavy chain variable region | TCN-542 (5079_A16) | US20150086555 SEQ ID NO: 255 | 4555 |
| INFL419 | Heavy chain variable region | TCN-543 (5081_G23) | US20150086555 SEQ ID NO: 267 | 4556 |
| INFL420 | Heavy chain variable region | TCN-544 (5082_A19) | US20150086555 SEQ ID NO: 279 | 4557 |
| INFL421 | Heavy chain variable region | TCN-545 (5082_I15) | US20150086555 SEQ ID NO: 291 | 4558 |
| INFL422 | Heavy chain variable region | TCN-546 (5089_L08) | US20150086555 SEQ ID NO: 302 | 4559 |
| INFL423 | Heavy chain variable region | TCN-547 (5092_F11) | US20150086555 SEQ ID NO: 313 | 4560 |
| INFL424 | Heavy chain variable region | TCN-548 (5092_P01) | US20150086555 SEQ ID NO: 325 | 4561 |
| INFL425 | Heavy chain variable region | TCN-549 (5092_P04) | US20150086555 SEQ ID NO: 335 | 4562 |
| INFL426 | Heavy chain variable region | TCN-550 (5096_F06) | US20150086555 SEQ ID NO: 346 | 4563 |
| INFL427 | Heavy chain variable region | TCN-551 (5243_D01) | US20150086555 SEQ ID NO: 358 | 4564 |
| INFL428 | Heavy chain variable region | TCN-552 (5249_I23) | US20150086555 SEQ ID NO: 370 | 4565 |
| INFL429 | Heavy chain variable region | TCN-553 (5261_C18) | US20150086555 SEQ ID NO: 382 | 4566 |

TABLE 21-continued

Antibodies against Influenza virus

| Antibody No. | Description | Antibody Name | Reference Information | SEQ ID NO |
|---|---|---|---|---|
| INFL430 | Heavy chain variable region | TCN-554 (5277_M05) | US20150086555 SEQ ID NO: 392 | 4567 |
| INFL431 | Heavy chain variable region | TCN-555 (5246_L16) | US20150086555 SEQ ID NO: 403 | 4568 |
| INFL432 | Heavy chain variable region | TCN-556 (5089_K12) | US20150086555 SEQ ID NO: 408 | 4569 |
| INFL433 | Heavy chain variable region | TCN-557 (5081_A04) | US20150086555 SEQ ID NO: 420 | 4570 |
| INFL434 | Heavy chain variable region | TCN-559 (5097_G08) | US20150086555 SEQ ID NO: 434 | 4571 |
| INFL435 | Heavy chain variable region | TCN-560 (5084_P10) | US20150086555 SEQ ID NO: 446 | 4572 |
| INFL436 | Heavy chain variable region | TCN-504 (3251_K17) | US20150086555 SEQ ID NO: 510 | 4573 |
| INFL437 | Heavy chain variable region | AB1 | US20120093834, WO2009121004 SEQ ID NO: 4 | 4574 |
| INFL438 | Heavy chain variable region | AB2 | US20120093834, WO2009121004 SEQ ID NO: 45 | 4575 |
| INFL439 | Heavy chain variable region | AB3 | US20120093834, WO2009121004 SEQ ID NO: 9 | 4576 |
| INFL440 | Heavy chain variable region | AB4, AB5, AB6 | US20120093834, WO2009121004 SEQ ID NO: 61 | 4577 |
| INFL441 | Heavy chain variable region | VN04-2 | WO2008033105 SEQ ID NO: 5 | 4578 |
| INFL442 | Heavy chain variable region | VN04-3 | WO2008033105 SEQ ID NO: 7 | 4579 |
| INFL443 | Heavy chain variable region | 1286-C05 | WO2010132604, US20120128671 SEQ ID NO: 1 | 4580 |
| INFL444 | Heavy chain variable region | 1286-A11 | WO2010132604, US20120128671 SEQ ID NO: 2 | 4581 |
| INFL445 | Heavy chain variable region | CR8001 | WO2010130636 SEQ ID NO: 2 | 4582 |
| INFL446 | Heavy chain variable region | CR8003 | WO2010130636 SEQ ID NO: 6 | 4583 |
| INFL447 | Heavy chain variable region | CR8015 | WO2010130636 SEQ ID NO: 10 | 4584 |
| INFL448 | Heavy chain variable region | CR8016 | WO2010130636 SEQ ID NO: 14 | 4585 |
| INFL449 | Heavy chain variable region | CR8017 | WO2010130636 SEQ ID NO: 18 | 4586 |
| INFL450 | Heavy chain variable region | CR8018 | WO2010130636 SEQ ID NO: 22 | 4587 |
| INFL451 | Heavy chain variable region (Partial) | anti-1918 influenza HA Ig | Yu, X., et al., Neutralizing antibodies derived from the B cells of 1918 influenza pandemic survivors; Nature 455 (7212), 532-536 (2008), NCBI Accession #ACI04581.1 (145aa) | 4588 |
| INFL452 | Heavy chain variable region mouse IgG | 1A2 | WO2015028478 SEQ ID NO: 2 | 4589 |
| INFL453 | Heavy chain variable region mouse IgG | 7B8 | WO2015028478 SEQ ID NO: 4 | 4590 |
| INFL454 | Heavy chain variable region, partial | monoclonal antibody TCN-031 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23854.1 (120aa) | 4591 |
| INFL455 | Heavy chain variable region, partial | monoclonal antibody TCN-032 | Grandea, A. G. et al., Human, antibodies reveal a protective epitope that is highly conserved among human and nonhuman influenza A viruses; Proc. Natl. Acad. Sci. U.S.A. 107 (28), 12658-12663 (2010), NCBI Accession #ADK23853.1 (120aa) | 4592 |
| INFL456 | Heavy chain variable region, partial | monoclonal antibody 3362_B11 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23869.1 (123aa) | 4593 |

TABLE 21-continued

Antibodies against Influenza virus

| Antibody No. | Description | Antibody Name | Reference Information | SEQ ID NO |
|---|---|---|---|---|
| INFL457 | Heavy chain variable region, partial | monoclonal antibody 3260_D19 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23868.1 (118aa) | 4594 |
| INFL458 | Heavy chain variable region, partial | monoclonal antibody 3253_P10 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23867.1 (121aa) | 4595 |
| INFL459 | Heavy chain variable region, partial | monoclonal antibody 3248_P18 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23866.1 (120aa) | 4596 |
| INFL460 | Heavy chain variable region, partial | monoclonal antibody 3139_P23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23865.1 (119aa) | 4597 |
| INFL461 | Heavy chain variable region, partial | monoclonal antibody 3420_I23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23864.1 (121aa) | 4598 |
| INFL462 | Heavy chain variable region, partial | monoclonal antibody 3255_J06 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23863.1 (119aa) | 4599 |
| INFL463 | Heavy chain variable region, partial | monoclonal antibody 3252_C13 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession # ADK23862.1 (119aa) | 4600 |
| INFL464 | Heavy chain variable region, partial | monoclonal antibody 3136_G05 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23861.1 (120aa) | 4601 |
| INFL465 | Heavy chain variable region, partial | monoclonal antibody 3244_H04 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23860.1 (118aa) | 4602 |
| INFL466 | Heavy chain variable region, partial | monoclonal antibody 3245_O19 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23859.1 (118aa) | 4603 |
| INFL467 | Heavy chain variable region, partial | monoclonal antibody 3259_J21 | Grandea, A. G. et al., Human antibodies reveal a protective epitope that is highly conserved among human and nonhuman influenza A viruses; Proc. Natl. Acad. | 4604 |

TABLE 21-continued

Antibodies against Influenza virus

| Antibody No. | Description | Antibody Name | Reference Information | SEQ ID NO |
|---|---|---|---|---|
| INFL468 | Heavy chain variable region, partial | monoclonal antibody 3243_J07 | Sci. U.S.A. 107 (28), 12658-12663 (2010), NCBI Accession #ADK23858.1 (120aa) Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23857.1 (121aa) | 4605 |
| INFL469 | Heavy chain variable region, partial | monoclonal antibody 3244_I10 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession # ADK23856.1 (121aa) | 4606 |
| INFL470 | Heavy chain variable region, partial | monoclonal antibody 3241_G23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23855.1 (122aa) | 4607 |
| INFL471 | Heavy chain variable region, partial | Monoclonal antibody clone 5E4 | Yasugi, M. et al., Emerging Antigenic Variants at the Antigenic Site Sb in Pandemic A(H1N1)2009 Influenza Virus in Japan Detected by a Human Monoclonal Antibody; PLoS ONE 8 (10), E77892 (2013), NCBI Accession #BAM76754.1 (141aa) | 4608 |
| INFL472 | Heavy chain variable region, partial | 100F4-HV | Hu, H., et al., A Human Antibody Recognizing a Conserved Epitope of H5 Hemagglutinin Broadly Neutralizes Highly Pathogenic Avian Influenza H5N1 Viruses; J. Virol. 86 (6), 2978-2989 (2012), NCBI Accession #AEL30603.1 (121aa) | 4609 |
| INFL473 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40460.1 (120aa) | 4610 |
| INFL474 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40459.1 (127aa) | 4611 |
| INFL475 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40458.1 (129aa) | 4612 |
| INFL476 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40457.1 (132aa) | 4613 |
| INFL477 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40456.1 (127aa) | 4614 |
| INFL478 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40455.1 (121aa) | 4615 |
| INFL479 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40454.1 (126aa) | 4616 |

TABLE 21-continued

Antibodies against Influenza virus

| Antibody No. | Description | Antibody Name | Reference Information | SEQ ID NO |
|---|---|---|---|---|
| INFL480 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40453.1 (120aa) | 4617 |
| INFL481 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40452.1 (122aa) | 4618 |
| INFL482 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40451.1 (125aa) | 4619 |
| INFL483 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40450.1 (126aa) | 4620 |
| INFL484 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40449.1 (129aa) | 4621 |
| INFL485 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40448.1 (119aa) | 4622 |
| INFL486 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40447.1 (120aa) | 4623 |
| INFL487 | Heavy chain variable region, partial, Anti-stem HA immunoglobulin | anti-stem HA immunoglobulin | Pappas, L. et al., Rapid development of broadly influenza neutralizing antibodies through redundant mutations; Nature (2014), NCBI Accession #AIN40446.1 (120aa) | 4624 |
| INFL488 | Heavy chain, Human igg, | Fab 39.29 | Nakamura, G. et al., An in vivo human-plasmablast enrichment technique allows rapid identification of therapeutic influenza a antibodies; Cell Host Microbe 14 (1), 93-103 (2013), NCBI Accession #4KVN_H (227aa) | 4625 |
| INFL489 | Heavy chain, Igg1 | Fab H5m9 | Zhu, X., et al., A Unique and Conserved Neutralization Epitope in H5N1 Influenza Viruses Identified by an Antibody against the A/Goose/Guangdong/1/96 Hemagglutinin; J. Virol. 87 (23), 12619-12635 (2013), NCBI Accession #4MHH_H (222aa) | 4626 |
| INFL490 | Immunoglobulin heavy chain variable region, partial | T2-6A | Huang, K.-Y. A., et al., Focused antibody-response to influenza linked to antigenic drift; J. Clin. Invest. (2015), NCBI Accession #AKF02484.1 (124aa) | 4627 |
| INFL491 | Kappa light chain constant region, human | | U.S. Pat. No. 8,992,929 SEQ ID NO. 24 | 4628 |
| INFL492 | Kappa light chain variable | 8D4 | NCBI Accession #AFI57037 | 4629 |
| INFL493 | Kappa light chain variable | 5B6 | NCBI Accession #AFI57041 | 4630 |
| INFL494 | Kappa light chain variable region | 8i10 | U.S. Pat. No. 8,858,948 SEQ ID NO: 56 | 4631 |
| INFL495 | Kappa light chain variable region | 23K12 | U.S. Pat. No. 8,858,948 SEQ ID NO: 91 | 4632 |
| INFL496 | Kappa light chain variable region | 4K8 | Krause, J. C. et al. "Epitope-specific human influenza antibody repertoires diversify by B cell intraclonal sequence divergence and interclonal convergence" | 4633 |

TABLE 21-continued

Antibodies against Influenza virus

| Antibody No. | Description | Antibody Name | Reference Information | SEQ ID NO |
|---|---|---|---|---|
| INFL497 | Kappa light chain variable region | 6D9 | J. Immunol. 187 (7), 3704-3711 (2011), NCBI Accession #AEO16800 Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16802 | 4634 |
| INFL498 | Kappa light chain variable region | 8G9 | U.S. Pat. No. 8,603,467 SEQ ID NO: 4 | 4635 |
| INFL499 | Kappa light chain variable region | 13D4 | U.S. Pat. No. 8,603,467 SEQ ID NO: 8 | 4636 |
| INFL500 | Kappa light chain variable region | 20A11 | U.S. Pat. No. 8,603,467 SEQ ID NO: 12 | 4637 |
| INFL501 | Kappa light chain variable region | EM4C04 | US20120282273 SEQ ID NO: 1 | 4638 |
| INFL502 | Kappa, light chain | Fab H5m9 | Zhu, X., et al., A Unique and Conserved Neutralization Epitope in H5N1 Influenza Viruses Identified by an Antibody against the A/Goose/Guangdong/1/96 Hemagglutinin; J. Virol. 87 (23), 12619-12635 (2013), NCBI Accession # 4MHH_L(218aa) | 4639 |
| INFL503 | Lambda light chain | 7A13 | Krause et al. "Human Monoclonal Antibodies to Pandemic 1957 H2N2 and Pandemic 1968 H3N2 Influenza Viruses" J. Virol. 86 (11), 6334-6340 (2012), NCBI Accession #AFH78448 | 4640 |
| INFL504 | Lambda light chain variable | 2K11 | Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16794 | 4641 |
| INFL505 | Lambda light chain variable | 2O10 | Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16796 | 4642 |
| INFL506 | Lambda light chain variable region, partial | Monoclonal antibody clone 5E4 | Yasugi, M. et al., Emerging Antigenic Variants at the Antigenic Site Sb in Pandemic A(H1N1)2009 Influenza Virus in Japan Detected by a Human Monoclonal Antibody; PLoS ONE 8 (10), E77892 (2013), NCBI Accession #BAM76755.1 (126aa) | 4643 |
| INFL507 | Lambda light chain variable region, partial, Immunoglobulin | T2-6A | Huang, K.-Y. A., et al., Focused antibody response to influenza linked to antigenic drift; J. Clin. Invest. (2015), NCBI Accession #AKF02488.1 (113aa) | 4644 |
| INFL508 | Light chain | CR6261, Diridavumab, CR-6261 | WO2008028946 | 4645 |
| INFL509 | Light chain | Firivumab, CT-P22 | US20130004505 | 4646 |
| INFL510 | Light chain | Navivumab, CT149 | WO2013048153, US20140234336 SEQ ID NO: 39 | 4647 |
| INFL511 | Light chain | AT10-004 | US20150010566, WO2013081463 SEQ ID NO: 36 | 4648 |
| INFL512 | Light chain | AT10-003 | US20150010566, WO2013081463 SEQ ID NO: 37 | 4649 |
| INFL513 | Light chain | AT10-002 | US20150010566, WO2013081463 SEQ ID NO: 38 | 4650 |
| INFL514 | Light chain | AT10-001 | US20150010566, WO2013081463 SEQ ID NO: 39 | 4651 |
| INFL515 | Light chain | AT10-005 | US20150010566, WO2013081463 SEQ ID NO: 40 | 4652 |
| INFL516 | Light chain | CT104 | WO2011111966, US20130004505 SEQ ID NO: 36 | 4653 |
| INFL517 | Light chain | CT120 | WO2011111966, US20130004505 SEQ ID NO: 40 | 4654 |
| INFL518 | Light chain | CT123 | WO2011111966, US20130004505 SEQ ID NO: 44 | 4655 |

TABLE 21-continued

Antibodies against Influenza virus

| Antibody No. | Description | Antibody Name | Reference Information | SEQ ID NO |
|---|---|---|---|---|
| INFL519 | Light chain | 2A | US20140011982 SEQ ID NO: 4 | 4656 |
| INFL520 | Light chain | F005-126 | WO2014049520, US20140086927 SEQ ID NO: 13 | 4657 |
| INFL521 | Light chain | BF1-1 | WO2008156763 SEQ ID NO: 8 | 4658 |
| INFL522 | Light chain | BF1-19 | WO2008156763 SEQ ID NO: 12 | 4659 |
| INFL523 | Light chain | BF1-10 | WO2008156763 SEQ ID NO: 10 | 4660 |
| INFL524 | Light chain | 2D1 | WO2010127252, U.S. Pat. No. 8,894,997 SEQ ID NO: 8 | 4661 |
| INFL525 | Light chain | 1F1 | WO2010127252, U.S. Pat. No. 8,894,997 SEQ ID NO: 2 | 4662 |
| INFL526 | Light chain | 4D20 | WO2010127252, U.S. Pat. No. 8,894,997 SEQ ID NO: 10 | 4663 |
| INFL527 | Light chain | A18 | WO13170139 SEQ ID NO: 95 | 4664 |
| INFL528 | Light chain | Ab A18 | U.S. Pat. No. 7,788,200 SEQ ID NO: 28 | 4665 |
| INFL529 | Light chain | Ab 067 | U.S. Pat. No. 7,788,200 SEQ ID NO: 153 | 4666 |
| INFL530 | Light chain | Ab 068 | U.S. Pat. No. 7,788,200 SEQ ID NO: 154 | 4667 |
| INFL531 | Light chain | Ab 069, Ab 079 | U.S. Pat. No. 7,788,200 SEQ ID NO: 155 | 4668 |
| INFL532 | Light chain | Ab 070 | U.S. Pat. No. 7,788,200 SEQ ID NO: 156 | 4669 |
| INFL533 | Light chain | Ab 073 | U.S. Pat. No. 7,788,200 SEQ ID NO: 165 | 4670 |
| INFL534 | Light chain | Ab 074, Ab 080 | U.S. Pat. No. 7,788,200 SEQ ID NO: 166 | 4671 |
| INFL535 | Light chain | Ab 075 | U.S. Pat. No. 7,788,200 SEQ ID NO: 167 | 4672 |
| INFL536 | Light chain | Ab 076 | U.S. Pat. No. 7,788,200 SEQ ID NO: 168 | 4673 |
| INFL537 | Light chain | Ab 077, Ab 081 | U.S. Pat. No. 7,788,200 SEQ ID NO: 169 | 4674 |
| INFL538 | Light chain | Ab 014, Ab 154, Ab 157 | U.S. Pat. No. 7,788,200 SEQ ID NO: 29 | 4675 |
| INFL539 | Light chain | Ab 028, Ab 155 | U.S. Pat. No. 7,788,200 SEQ ID NO: 30 | 4676 |
| INFL540 | Light chain | Ab 001, Ab 002, Ab 003 | U.S. Pat. No. 7,788,200 SEQ ID NO: 31 | 4677 |
| INFL541 | Light chain | Ab 009, Ab 010, Ab 011 | U.S. Pat. No. 7,788,200 SEQ ID NO: 32 | 4678 |
| INFL542 | Light chain | Ab 017, Ab B18, Ab B18, Ab 019, Ab 019 | U.S. Pat. No. 7,788,200 SEQ ID NO: 33 | 4679 |
| INFL543 | Light chain | Ab 025, Ab 026, Ab 027, Ab 028 | U.S. Pat. No. 7,788,200 SEQ ID NO: 34 | 4680 |
| INFL544 | Light chain | Ab 159 | U.S. Pat. No. 7,788,200 SEQ ID NO: 35 | 4681 |
| INFL545 | Light chain | Ab 160 | U.S. Pat. No. 7,788,200 SEQ ID NO: 36 | 4682 |
| INFL546 | Light chain | Ab 186, Ab 194 | U.S. Pat. No. 7,788,200 SEQ ID NO: 37 | 4683 |
| INFL547 | Light chain | Ab 187, Ab 195 | U.S. Pat. No. 7,788,200 SEQ ID NO: 38 | 4684 |
| INFL548 | Light chain | Ab 188, Ab 196 | U.S. Pat. No. 7,788,200 SEQ ID NO: 39 | 4685 |
| INFL549 | Light chain | Ab 189, Ab 197 | U.S. Pat. No. 7,788,200 SEQ ID NO: 40 | 4686 |
| INFL550 | Light chain | Ab 190, Ab 198 | U.S. Pat. No. 7,788,200 SEQ ID NO: 41 | 4687 |
| INFL551 | Light chain | Ab 191, Ab 199 | U.S. Pat. No. 7,788,200 SEQ ID NO: 42 | 4688 |
| INFL552 | Light chain | Ab 192, Ab 200 | U.S. Pat. No. 7,788,200 SEQ ID NO: 43 | 4689 |
| INFL553 | Light chain | Ab 193 | U.S. Pat. No. 7,788,200 SEQ ID NO: 44 | 4690 |
| INFL554 | Light chain | Ab 202, Ab 203, Ab 204, Ab 210, Ab 031, Ab 032, Ab 033, Ab 034 | U.S. Pat. No. 7,788,200 SEQ ID NO: 45 | 4691 |
| INFL555 | Light chain | Ab 211, Ab 212, Ab 213, Ab 219, Ab 037, Ab 038, Ab 039, Ab 040 | U.S. Pat. No. 7,788,200 SEQ ID NO: 46 | 4692 |
| INFL556 | Light chain | Ab A001, Ab 004, Ab 007, Ab 016 | U.S. Pat. No. 7,788,200 SEQ ID NO: 47 | 4693 |
| INFL557 | Light chain | Ab A002, Ab 005, Ab 008, Ab A017 | U.S. Pat. No. 7,788,200 SEQ ID NO: 48 | 4694 |
| INFL558 | Light chain | Ab A003, Ab 006, Ab A009, Ab C18 | U.S. Pat. No. 7,788,200 SEQ ID NO: 49 | 4695 |
| INFL559 | Light chain | Ab A010, Ab 012, Ab A14, Ab A019 | U.S. Pat. No. 7,788,200 SEQ ID NO: 50 | 4696 |
| INFL560 | Light chain | Ab A011, Ab 013m Ab 0135 | U.S. Pat. No. 7,788,200 SEQ ID NO: 51 | 4697 |
| INFL561 | Light chain | Ab 044, Ab 071, Ab 072, Ab 078 | U.S. Pat. No. 7,788,200 SEQ ID NO: 52 | 4698 |
| INFL562 | Light chain | Ab 051 | U.S. Pat. No. 7,788,200 SEQ ID NO: 53 | 4699 |
| INFL563 | Light chain | Ab 049 | U.S. Pat. No. 7,788,200 SEQ ID NO: 54 | 4700 |
| INFL564 | Light chain | Ab 047 | U.S. Pat. No. 7,788,200 SEQ ID NO: 55 | 4701 |
| INFL565 | Light chain | Ab 050 | U.S. Pat. No. 7,788,200 SEQ ID NO: 56 | 4702 |
| INFL566 | Light chain | Ab 045 | U.S. Pat. No. 7,788,200 SEQ ID NO: 57 | 4703 |
| INFL567 | Light chain | Ab 048 | U.S. Pat. No. 7,788,200 SEQ ID NO: 58 | 4704 |
| INFL568 | Light chain | Ab 046 | U.S. Pat. No. 7,788,200 SEQ ID NO: 59 | 4705 |
| INFL569 | Light chain | Ab 043 | U.S. Pat. No. 7,788,200 SEQ ID NO: 60 | 4706 |
| INFL570 | Light chain | Ab 052 | U.S. Pat. No. 7,788,200 SEQ ID NO: 61 | 4707 |

TABLE 21-continued

Antibodies against Influenza virus

| Antibody No. | Description | Antibody Name | Reference Information | SEQ ID NO |
|---|---|---|---|---|
| INFL571 | Light chain | F005-126 | WO2014049520 SEQ ID 13 | 4708 |
| INFL572 | Light chain | 8f24 | WO2012045001 SEQ ID 3 | 4709 |
| INFL573 | Light chain | 3E22 | WO2012045001 SEQ ID 7 | 4710 |
| INFL574 | Light chain | 5117 | WO2012045001 SEQ ID 11 | 4711 |
| INFL575 | Light chain | | WO2012045001 SEQ ID 15 | 4712 |
| INFL576 | Light chain | | WO2012045001 SEQ ID 31 | 4713 |
| INFL577 | Light chain | | WO2012045001 SEQ ID 35 | 4714 |
| INFL578 | Light chain | | WO2012045001 SEQ ID 19 | 4715 |
| INFL579 | Light chain | 10A14 | WO2012045001 SEQ ID 23 | 4716 |
| INFL580 | Light chain | 8D4 | WO2012045001 SEQ ID 27 | 4717 |
| INFL581 | Light chain | 2B9 | U.S. Pat. No. 9,115,201 SEQ ID NO: 5 | 4718 |
| INFL582 | Light chain | mAB 7A7 | US20150239960, US20140170163, U.S. Pat. No. 8,673,314, US20110027270, WO2010138564 SEQ ID NO: 7 | 4719 |
| INFL583 | Light chain | mAB 12D1 | US20150239960, US20140170163, U.S. Pat. No. 8,673,314, US20110027270, WO2010138564 SEQ ID NO: 13 | 4720 |
| INFL584 | Light chain | mAB 66A6 | US20150239960, US20140170163, U.S. Pat. No. 8,673,314, US20110027270, WO2010138564 SEQ ID NO: 17 | 4721 |
| INFL585 | Light chain | M1 D12 | US20110033473, WO2009125395 SEQ ID NO: 15 | 4722 |
| INFL586 | Light chain | mAB1.12 | WO2013030165 SEQ ID NO: 2 | 4723 |
| INFL587 | Light chain | mAB3.1 | WO2013030165 SEQ ID NO: 4 | 4724 |
| INFL588 | Light chain | 5A7 | WO2015120097 SEQ ID NO: 8 | 4725 |
| INFL589 | Light chain | TRL053 | WO2015120097 SEQ ID NO: 18 | 4726 |
| INFL590 | Light chain | TRL579 | WO2015120097 SEQ ID NO: 28 | 4727 |
| INFL591 | Light chain | TRL784 | WO2015120097 SEQ ID NO: 38 | 4728 |
| INFL592 | Light chain | TRL794 | WO2015120097 SEQ ID NO: 48 | 4729 |
| INFL593 | Light chain | TRL798 | WO2015120097 SEQ ID NO: 58 | 4730 |
| INFL594 | Light chain | TRL799 | WO2015120097 SEQ ID NO: 68 | 4731 |
| INFL595 | Light chain | TRL809 | WO2015120097 SEQ ID NO: 78 | 4732 |
| INFL596 | Light chain | TRL811 | WO2015120097 SEQ ID NO: 88 | 4733 |
| INFL597 | Light chain | TRL812 | WO2015120097 SEQ ID NO: 98 | 4734 |
| INFL598 | Light chain | TRL813 | WO2015120097 SEQ ID NO: 108 | 4735 |
| INFL599 | Light chain | TRL823 | WO2015120097 SEQ ID NO: 118 | 4736 |
| INFL600 | Light chain | TRL832 | WO2015120097 SEQ ID NO: 128 | 4737 |
| INFL601 | Light chain | TRL833 | WO2015120097 SEQ ID NO: 138 | 4738 |
| INFL602 | Light chain | TRL834 | WO2015120097 SEQ ID NO: 148 | 4739 |
| INFL603 | Light chain | TRL837 | WO2015120097 SEQ ID NO: 167 | 4740 |
| INFL604 | Light chain | TRL839 | WO2015120097 SEQ ID NO: 177 | 4741 |
| INFL605 | Light chain | TRL841 | WO2015120097 SEQ ID NO: 187 | 4742 |
| INFL606 | Light chain | TRL842 | WO2015120097 SEQ ID NO: 197 | 4743 |
| INFL607 | Light chain | TRL845 | WO2015120097 SEQ ID NO: 207 | 4744 |
| INFL608 | Light chain | TRL846 | WO2015120097 SEQ ID NO: 218 | 4745 |
| INFL609 | Light chain | TRL847 | WO2015120097 SEQ ID NO: 228 | 4746 |
| INFL610 | Light chain | TRL848 | WO2015120097 SEQ ID NO: 238 | 4747 |
| INFL611 | Light chain | TRL849 | WO2015120097 SEQ ID NO: 248 | 4748 |
| INFL612 | Light chain | TRL851 | WO2015120097 SEQ ID NO: 258 | 4749 |
| INFL613 | Light chain | TRL854 | WO2015120097 SEQ ID NO: 268 | 4750 |
| INFL614 | Light chain | TRL856 | WO2015120097 SEQ ID NO: 278 | 4751 |
| INFL615 | Light chain | TRL858 | WO2015120097 SEQ ID NO: 288 | 4752 |
| INFL616 | Light chain | humM2e-hBiTE-1 | WO2014140368 SEQ ID NO: 10 | 4753 |
| INFL617 | Light chain | humM2e-hBiTE-2 | WO2014140368 SEQ ID NO: 18 | 4754 |
| INFL618 | Light chain | humM2e-hBiTE-3 | WO2014140368 SEQ ID NO: 26 | 4755 |
| INFL619 | Light chain | humM2e-hBiTE-4 | WO2014140368 SEQ ID NO: 34 | 4756 |
| INFL620 | Light chain | VH of humM2e-hBiTE-5 | WO2014140368 SEQ ID NO: 42 | 4757 |
| INFL621 | Light chain | humM2e-hBiTE-6 | WO2014140368 SEQ ID NO: 50 | 4758 |
| INFL622 | Light chain | humM2e-hBiTE-7 | WO2014140368 SEQ ID NO: 58 | 4759 |
| INFL623 | Light chain | humM2e-hBiTE-8 | WO2014140368 SEQ ID NO: 66 | 4760 |
| INFL624 | Light chain | humM2e-hBiTE-9 | WO2014140368 SEQ ID NO: 74 | 4761 |
| INFL625 | Light chain | murM2e-hBiTE | WO2014140368 SEQ ID NO: 82 | 4762 |
| INFL626 | Light chain | FLA5.10 | U.S. Pat. No. 8,124,092 SEQ ID NO: 3 | 4763 |
| INFL627 | Light chain | FLD21.140 | U.S. Pat. No. 8,124,092 SEQ ID NO: 7 | 4764 |
| INFL628 | Light chain | FLA3.14 | U.S. Pat. No. 8,124,092 SEQ ID NO: 11 | 4765 |
| INFL629 | Light chain | FLD20.19 | U.S. Pat. No. 8,124,092 SEQ ID NO: 15 | 4766 |
| INFL630 | Light chain | FLD84 | U.S. Pat. No. 8,124,092 SEQ ID NO: 44 | 4767 |
| INFL631 | Light chain | FLD93 | U.S. Pat. No. 8,124,092 SEQ ID NO: 54 | 4768 |
| INFL632 | Light chain | FLD122 | U.S. Pat. No. 8,124,092 SEQ ID NO: 64 | 4769 |
| INFL633 | Light chain | FLD127 | U.S. Pat. No. 8,124,092 SEQ ID NO: 74 | 4770 |
| INFL634 | Light chain | FLD129 | U.S. Pat. No. 8,124,092 SEQ ID NO: 84 | 4771 |
| INFL635 | Light chain | FLD132 | U.S. Pat. No. 8,124,092 SEQ ID NO: 94 | 4772 |
| INFL636 | Light chain | FLD194 | U.S. Pat. No. 8,124,092 SEQ ID NO: 104 | 4773 |

TABLE 21-continued

Antibodies against Influenza virus

| Antibody No. | Description | Antibody Name | Reference Information | SEQ ID NO |
|---|---|---|---|---|
| INFL637 | Light chain | mAb1 | WO2015112994 SEQ ID NO: 77 | 4774 |
| INFL638 | Light chain | mAb2 | WO2015112994 SEQ ID NO: 81 | 4775 |
| INFL639 | Light chain | mAb3 | WO2015112994 SEQ ID NO: 85 | 4776 |
| INFL640 | Light chain | CT-P22 | US20130004505 SEQ ID NO: 40; WO2011/111966 | 4777 |
| INFL641 | Light chain | C05 | Ekiert, D. C., et al., Cross-neutralization of influenza A viruses mediated by a single antibody loop; Nature 489 (7417), 526-532 (2012), NCBI Accession #4FNL_L (214aa) | 4778 |
| INFL642 | Light chain | CR8020 | Ekiert, D. C., et al., A highly conserved neutralizing epitope on group 2 influenza A viruses; Science 333 (6044), 843-850 (2011); WO2010130636, NCBI Accession #3SDY_L | 4779 |
| INFL643 | Light chain | CR8033 | Dreyfus, C., Laursen, N. S. et al., Highly conserved protective epitopes on influenza B viruses; Science 337 (6100), 1343-1348 (2012), NCBI Accession # 4FQL_L | 4780 |
| INFL644 | Light chain | CR8043 | Friesen, R. H. et al., A common solution to group 2 influenza virus neutralization; Proc. Natl. Acad. Sci. U.S.A. 111 (1), 445-450 (2014), NCBI Accession #4NM8_L | 4781 |
| INFL645 | Light chain | CR8059 | Dreyfus, C. et al., Highly conserved protective epitopes on influenza B viruses; Science 337 (6100), 1343-1348 (2012), NCBI Accession #4FQK_L | 4782 |
| INFL646 | Light chain | CR8071 | Dreyfus, C. et al., Highly conserved protective epitopes on influenza B viruses; Science 337 (6100), 1343-1348 (2012), NCBI Accession # 4FQJ_L (216aa) | 4783 |
| INFL647 | Light chain | CR9114 | WO2013079473; WO2014191435; Dreyfus, C., Laursen, N. S. et al., Highly conserved protective epitopes on influenza B viruses; Science 337 (6100), 1343-1348 (2012), NCBI Accession #4FQY_L(216aa) | 4784 |
| INFL648 | Light chain | Ch67 | Schmidt, A. G., et al., Preconfiguration of the antigen-binding site during affinity maturation of a broadly neutralizing influenza virus antibody; Proc. Natl. Acad. Sci. U.S.A. 110 (1), 264-269 (2013), NCBI Accession #4HKX_B (214aa) | 4785 |
| INFL649 | Light chain | Fab 26/9 | Schulze-Gahmen, U. et al., J. Biol. Chem. 263 (32), 17100-17105 (1988); Churchill, M. E., et al., J. Mol. Biol. 241 (4), 534-556 (1994), NCBI Accession #LFRG_L | 4786 |
| INFL650 | Light chain | Fab 3.1 | Wyrzucki, A. et al., Alternative Recognition of the Conserved Stem Epitope in Influenza A Virus Hemagglutinin by a VH3-30-Encoded Heterosubtypic Antibody; J. Virol. 88 (12), 7083-7092 (2014), NCBI Accession #4PY8_J | 4787 |
| INFL651 | Light chain | Fab 2g1 | Xu, R. et al., A recurring motif for antibody recognition of the receptor-binding site of influenza hemagglutinin; Nat. Struct. Mol. Biol. 20 (3), 363-370 (2013), NCBI Accession #4HG4_M (214aa) | 4788 |
| INFL652 | Light chain | Fab 8m2 | Xu, R. et al., A recurring motif for antibody recognition of the receptor-binding site of influenza hemagglutinin; Nat. Struct. Mol. Biol. 20 (3), 363-370 (2013), NCBI Accession #4HFU_L (215aa) | 4789 |
| INFL653 | Light chain | Fab 8f8 | Xu, R. et al., A recurring motif for antibody recognition of the receptor-binding site of influenza hemagglutinin; | 4790 |

TABLE 21-continued

Antibodies against Influenza virus

| Antibody No. | Description | Antibody Name | Reference Information | SEQ ID NO |
|---|---|---|---|---|
| INFL654 | Light chain | Fab 2d1 | Nat. Struct. Mol. Biol. 20 (3), 363-370 (2013), NCBI Accession # 4HF5_L (218aa) Xu, R., et al., Structural basis of preexisting immunity to the 2009 H1N1 pandemic influenza virus; Science 328 (5976), 357-360 (2010), NCBI Accession #3LZF_L (217aa) | 4791 |
| INFL655 | Light chain | Fi6v3 | Corti, D. et al., A neutralizing antibody selected from plasma cells that binds to group 1 and group 2 influenza A hemagglutinins; Science 333 (6044), 850-856 (2011), NCBI Accession #3ZTN_L | 4792 |
| INFL656 | Light chain | Light chain from 3WHE_N | Iba, Y., et al., Conserved Neutralizing Epitope at Globular Head of Hemagglutinin in H3N2 Influenza Viruses; J. Virol. (2014), NCBI Accession #3WHE_N (220aa) | 4793 |
| INFL657 | Light chain (partial) | monoclonal antibody PN-SIA28 | Burioni, R. et al., Monoclonal antibodies isolated from human B cells neutralize a broad range of H1 subtype influenza A viruses including swine-origin Influenza virus(S-OIV); Virology (2010), NCBI Accession #ACX30939.1 (105aa) | 4794 |
| INFL658 | Light chain (partial) | monoclonal antibody PN-SIA49 | Burioni, R. et al., Monoclonal antibodies isolated from human B cells neutralize a broad range of H1 subtype influenza A viruses including swine-origin Influenza virus(S-OIV); Virology (2010), NCBI Accession #ACX30938.1 (105aa) | 4795 |
| INFL659 | Light chain; Fab | 5j8 | Hong, M. et al., Antibody Recognition of the Pandemic H1N1 Influenza Virus Hemagglutinin Receptor Binding Site; J. Virol. 87 (22), 12471-12480 (2013), NCBI Accession #4M5Z_L | 4796 |
| INFL660 | Light chain CDR 1 | Ab1A2 | WO2015028478 SEQ ID 9 | 4797 |
| INFL661 | Light chain CDR 2 | Ab1A2 | WO2015028478 SEQ ID 10 | 4798 |
| INFL662 | Light chain CDR 3 | Ab1A2 | WO2015028478 SEQ ID 11 | 4799 |
| INFL663 | Light chain Fab | CT147 | WO2013048153, US20140234336 SEQ ID NO: 37 | 4800 |
| INFL664 | Light chain Fab | CT164 | WO2013048153, US20140234336 SEQ ID NO: 41 | 4801 |
| INFL665 | Light chain Fab | CT166 | WO2013048153, US20140234336 SEQ ID NO: 43 | 4802 |
| INFL666 | Light chain Human igg | Fab 39.29 | Nakamura, G. et al., An in vivo human-plasmablast enrichment technique allows rapid identification of therapeutic influenza a antibodies; Cell Host Microbe 14 (1), 93-103 (2013), NCBI Accession #4KVN_L (215aa) | 4803 |
| INFL667 | Light chain K3 | h2B11 | U.S. Pat. No. 9,115,201 SEQ ID NO: 9 | 4804 |
| INFL668 | Light chain K3 | h2B12 | U.S. Pat. No. 9,115,201 SEQ ID NO: 10 | 4805 |
| INFL669 | Light chain partial region | 4A10 | Krause, J. C. et al. "Epitope-specific human influenza antibody repertoires diversify by B cell intraclonal sequence divergence and interclonal convergence" J. Immunol. 187 (7), 3704-3711 (2011), NCBI Accession #AEO16798 | 4806 |
| INFL670 | Light chain variable (exemplary) | LC-VD from US2013030234 | US2013030234 SEQ ID NO: 33 | 4807 |
| INFL671 | Light chain variable (exemplary) | LC-VD from US2013030234 | US2013030234 SEQ ID NO: 34 | 4808 |
| INFL672 | Light chain variable (exemplary) | LC-VD from US2013030234 | US2013030234 SEQ ID NO: 35 | 4809 |
| INFL673 | Light chain variable (exemplary) | LC-VD from US2013030234 | US2013030234 SEQ ID NO: 36 | 4810 |
| INFL674 | Light chain variable (exemplary) | LC-VD from US2013030234 | US2013030234 SEQ ID NO: 37 | 4811 |
| INFL675 | Light chain variable (exemplary) | LC-VD from US2013030234 | US2013030234 SEQ ID NO: 38 | 4812 |
| INFL676 | Light chain variable (exemplary) | LC-VD from US2013030234 | US2013030234 SEQ ID NO: 39 | 4813 |

TABLE 21-continued

Antibodies against Influenza virus

| Antibody No. | Description | Antibody Name | Reference Information | SEQ ID NO |
|---|---|---|---|---|
| INFL677 | Light chain variable (exemplary) | LC-VD from US2013030234 | US2013030234 SEQ ID NO: 40 | 4814 |
| INFL678 | Light chain variable (exemplary) | LC-VD from US2013030234 | US2013030234 SEQ ID NO: 41 | 4815 |
| INFL679 | Light chain variable (exemplary) | LC-VD from US2013030234 | US2013030234 SEQ ID NO: 42 | 4816 |
| INFL680 | Light chain variable (exemplary) | LC-VD from US2013030234 | US2013030234 SEQ ID NO: 43 | 4817 |
| INFL681 | Light chain variable region | 39.18 B11 | US20140161822 SEQ ID NO: 156 | 4818 |
| INFL682 | Light chain variable region | GG3 | WO2014159960 SEQ ID NO: 25 | 4819 |
| INFL683 | Light chain variable region | N547 | U.S. Pat. No. 8,003,106 SEQ ID NO: 29 | 4820 |
| INFL684 | Light chain variable region | L66 | U.S. Pat. No. 8,003,106 SEQ ID NO: 31 | 4821 |
| INFL685 | Light chain variable region | C40 | U.S. Pat. No. 8,003,106 SEQ ID NO: 27 | 4822 |
| INFL686 | Light chain variable region | 14C2 | U.S. Pat. No. 8,080,244 SEQ ID NO: 7 | 4823 |
| INFL687 | Light chain variable region | h14C2 | U.S. Pat. No. 8,080,244 SEQ ID NO: 1 | 4824 |
| INFL688 | Light chain variable region | VN04-2-HuG1 | US20100150941 SEQ ID NO: 6 | 4825 |
| INFL689 | Light chain variable region | VN04-3-HuG1 | US20100150941 SEQ ID NO: 8 | 4826 |
| INFL690 | Light chain variable region | FI6 variant 1, FI6 variant 2 | U.S. Pat. No. 8,871,207 SEQ ID NO: 14 | 4827 |
| INFL691 | Light chain variable region | FI6 variant 3, FI6 variant 4 | U.S. Pat. No. 8,871,207 SEQ ID NO: 57 | 4828 |
| INFL692 | Light chain variable region | FI6 variant 5 | U.S. Pat. No. 8,871,207 SEQ ID NO: 61 | 4829 |
| INFL693 | Light chain variable region | FI28 variant 1, FI28 variant 2 | U.S. Pat. No. 8,871,207 SEQ ID NO: 30 | 4830 |
| INFL694 | Light chain variable region | 21B15 | U.S. Pat. No. 8,858,948 SEQ ID NO: 46 | 4831 |
| INFL695 | Light chain variable region | 3241_G23 | U.S. Pat. No. 8,858,948 SEQ ID NO: 118 | 4832 |
| INFL696 | Light chain variable region | 3244_I10 | U.S. Pat. No. 8,858,948 SEQ ID NO: 122 | 4833 |
| INFL697 | Light chain variable region | 3243_J07 | U.S. Pat. No. 8,858,948 SEQ ID NO: 126 | 4834 |
| INFL698 | Light chain variable region | 3259_J21 | U.S. Pat. No. 8,858,948 SEQ ID NO: 130 | 4835 |
| INFL699 | Light chain variable region | 3245_O19 | U.S. Pat. No. 8,858,948 SEQ ID NO: 134 | 4836 |
| INFL700 | Light chain variable region | 3244_H04 | U.S. Pat. No. 8,858,948 SEQ ID NO: 138 | 4837 |
| INFL701 | Light chain variable region | 3136_G05 | U.S. Pat. No. 8,858,948 SEQ ID NO: 142 | 4838 |
| INFL702 | Light chain variable region | 3252_C13 | U.S. Pat. No. 8,858,948 SEQ ID NO: 146 | 4839 |
| INFL703 | Light chain variable region | 3255_J06 | U.S. Pat. No. 8,858,948 SEQ ID NO: 150 | 4840 |
| INFL704 | Light chain variable region | 3420_I23 | U.S. Pat. No. 8,858,948 SEQ ID NO: 154 | 4841 |
| INFL705 | Light chain variable region | 3248_P18 | U.S. Pat. No. 8,858,948 SEQ ID NO: 160 | 4842 |
| INFL706 | Light chain variable region | 3253_P10 | U.S. Pat. No. 8,858,948 SEQ ID NO: 164 | 4843 |
| INFL707 | Light chain variable region | 3260_D19 | U.S. Pat. No. 8,858,948 SEQ ID NO: 168 | 4844 |
| INFL708 | Light chain variable region | 3362_B11 | U.S. Pat. No. 8,858,948 SEQ ID NO: 174 | 4845 |
| INFL709 | Light chain variable region | 3242_P05 | U.S. Pat. No. 8,858,948 SEQ ID NO: 178 | 4846 |
| INFL710 | Light chain variable region | A66 | WO2009079259, US20110038935, US20140011982 SEQ ID NO: 34 | 4847 |
| INFL711 | Light chain variable region | D7, H98 | WO2009079259, US20110038935, US20140011982 SEQ ID NO: 8 | 4848 |
| INFL712 | Light chain variable region | D8 | WO2009079259, US20110038935, US20140011982 SEQ ID NO: 14 | 4849 |
| INFL713 | Light chain variable region | D80 | WO2009079259, US20110038935, US20140011982 SEQ ID NO: 16 | 4850 |

TABLE 21-continued

Antibodies against Influenza virus

| Antibody No. | Description | Antibody Name | Reference Information | SEQ ID NO |
|---|---|---|---|---|
| INFL714 | Light chain variable region | E88 | WO2009079259, US20110038935, US20140011982 SEQ ID NO: 38 | 4851 |
| INFL715 | Light chain variable region | E90 | WO2009079259, US20110038935, US20140011982 SEQ ID NO: 22 | 4852 |
| INFL716 | Light chain variable region | F10 | WO2009079259, US20110038935, US20140011982 SEQ ID NO: 20 | 4853 |
| INFL717 | Light chain variable region | G17 | WO2009079259, US20110038935, US20140011982 SEQ ID NO: 26 | 4854 |
| INFL718 | Light chain variable region | H40 | WO2009079259, US20110038935, US20140011982 SEQ ID NO: 30 | 4855 |
| INFL719 | Light chain variable region | H98 | WO2009079259, US20110038935, US20140011982 SEQ ID NO: 10 | 4856 |
| INFL720 | Light chain variable region | CH65 | WO2013020074, US20140302043 SEQ ID NO: 10 | 4857 |
| INFL721 | Light chain variable region | CH66 | WO2013020074, US20140302043 SEQ ID NO: 11 | 4858 |
| INFL722 | Light chain variable region | CH67 | WO2013020074, US20140302043 SEQ ID NO: 12 | 4859 |
| INFL723 | Light chain variable region | CL86OUCA | WO2013020074, US20140302043 SEQ ID NO: 9 | 4860 |
| INFL724 | Light chain variable region | Antibody 1 | WO2015051010 SEQ ID NO: 7 | 4861 |
| INFL725 | Light chain variable region | Antibody 2 | WO2015051010 SEQ ID NO: 17 | 4862 |
| INFL726 | Light chain variable region | Antibody 3 | WO2015051010 SEQ ID NO: 27 | 4863 |
| INFL727 | Light chain variable region | Antibody 4 | WO2015051010 SEQ ID NO: 37 | 4864 |
| INFL728 | Light chain variable region | Antibody 5 | WO2015051010 SEQ ID NO: 47 | 4865 |
| INFL729 | Light chain variable region | Antibody 6 | WO2015051010 SEQ ID NO: 57 | 4866 |
| INFL730 | Light chain variable region | Antibody 7 | WO2015051010 SEQ ID NO: 67 | 4867 |
| INFL731 | Light chain variable region | Antibody 8 | WO2015051010 SEQ ID NO: 77 | 4868 |
| INFL732 | Light chain variable region | Antibody 9 | WO2015051010 SEQ ID NO: 87 | 4869 |
| INFL733 | Light chain variable region | Antibody 10 | WO2015051010 SEQ ID NO: 97 | 4870 |
| INFL734 | Light chain variable region | Antibody 11 | WO2015051010 SEQ ID NO: 107 | 4871 |
| INFL735 | Light chain variable region | Antibody 12 | WO2015051010 SEQ ID NO: 117 | 4872 |
| INFL736 | Light chain variable region | Antibody 13 | WO2015051010 SEQ ID NO: 127 | 4873 |
| INFL737 | Light chain variable region | Antibody 14 | WO2015051010 SEQ ID NO: 137 | 4874 |
| INFL738 | Light chain variable region | Antibody 15 | WO2015051010 SEQ ID NO: 147 | 4875 |
| INFL739 | Light chain variable region | Antibody 3-GL | WO2015051010 SEQ ID NO: 157 | 4876 |
| INFL740 | Light chain variable region | 005-2G02 | WO2013059524, US20140348851 SEQ ID NO: 11 | 4877 |
| INFL741 | Light chain variable region | 005-2G02 | WO2013059524, US20140348851 SEQ ID NO: 19 | 4878 |
| INFL742 | Light chain variable region | 09-2A06 | WO2013059524, US20140348851 SEQ ID NO: 31 | 4879 |
| INFL743 | Light chain variable region | 09-2A06 | WO2013059524, US20140348851 SEQ ID NO: 39 | 4880 |
| INFL744 | Light chain variable region | 09-3A01 | WO2013059524, US20140348851 SEQ ID NO: 51 | 4881 |
| INFL745 | Light chain variable region | 09-3A01 | WO2013059524, US20140348851 SEQ ID NO: 59 | 4882 |
| INFL746 | Light chain variable region | 70-IF02 | WO2012096994, US20140046039 SEQ ID NO: 21 | 4883 |
| INFL747 | Light chain variable region | | US20120058124 SEQ ID NO: 15 | 4884 |
| INFL748 | Light chain variable region | | US20120058124 SEQ ID NO: 16 | 4885 |
| INFL749 | Light chain variable region | | US20120058124 SEQ ID NO: 17 | 4886 |
| INFL750 | Light chain variable region | | US20120058124 SEQ ID NO: 18 | 4887 |

TABLE 21-continued

Antibodies against Influenza virus

| Antibody No. | Description | Antibody Name | Reference Information | SEQ ID NO |
|---|---|---|---|---|
| INFL751 | Light chain variable region | | US20120058124 SEQ ID NO: 19 | 4888 |
| INFL752 | Light chain variable region | | US20120058124 SEQ ID NO: 20 | 4889 |
| INFL753 | Light chain variable region | | US20120058124 SEQ ID NO: 21 | 4890 |
| INFL754 | Light chain variable region | | US20120058124 SEQ ID NO: 22 | 4891 |
| INFL755 | Light chain variable region | | US20120058124 SEQ ID NO: 23 | 4892 |
| INFL756 | Light chain variable region | | US20120058124 SEQ ID NO: 24 | 4893 |
| INFL757 | Light chain variable region | | US20120058124 SEQ ID NO: 25 | 4894 |
| INFL758 | Light chain variable region | | US20120058124 SEQ ID NO: 26 | 4895 |
| INFL759 | Light chain variable region | | US20120058124 SEQ ID NO: 70 | 4896 |
| INFL760 | Light chain variable region | 81.39 | US20140161822, US20140248286, WO2014078268 SEQ ID NO: 113 | 4897 |
| INFL761 | Light chain variable region | 81.39 | US20140161822, US20140248286, WO2014078268 SEQ ID NO: 117 | 4898 |
| INFL762 | Light chain variable region | 81.39 | US20140161822, US20140248286, WO2014078268 SEQ ID NO: 119 | 4899 |
| INFL763 | Light chain variable region | 81.39 | US20140161822, US20140248286, WO2014078268 SEQ ID NO: 122 | 4900 |
| INFL764 | Light chain variable region | 81.39 | US20140161822, US20140248286, WO2014078268 SEQ ID NO: 124 | 4901 |
| INFL765 | Light chain variable region | 81.39 | US20140161822, US20140248286, WO2014078268 SEQ ID NO: 126 | 4902 |
| INFL766 | Light chain variable region | 81.39 | US20140161822, US20140248286, WO2014078268 SEQ ID NO: 128 | 4903 |
| INFL767 | Light chain variable region | 81.39 | US20140161822, US20140248286, WO2014078268 SEQ ID NO: 130 | 4904 |
| INFL768 | Light chain variable region | 81.39 | US20140161822, US20140248286, WO2014078268 SEQ ID NO: 132 | 4905 |
| INFL769 | Light chain variable region | 39.29 | US20140161822, US20140248286, WO2014078268 SEQ ID NO: 136 | 4906 |
| INFL770 | Light chain variable region | 39.29 | US20140161822, US20140248286, WO2014078268 SEQ ID NO: 140 | 4907 |
| INFL771 | Light chain variable region | 39.29 | US20140161822, US20140248286, WO2014078268 SEQ ID NO: 144 | 4908 |
| INFL772 | Light chain variable region | 39.29 | US20140161822, US20140248286, WO2014078268 SEQ ID NO: 146 | 4909 |
| INFL773 | Light chain variable region | 39.29 | US20140161822, US20140248286, WO2014078268 SEQ ID NO: 150 | 4910 |
| INFL774 | Light chain variable region | 39.29 | US20140161822, US20140248286, WO2014078268 SEQ ID NO: 152 | 4911 |
| INFL775 | Light chain variable region | 36.89 | US20140161822, US20140248286, WO2014078268 SEQ ID NO: 162 | 4912 |
| INFL776 | Light chain variable region | 9.01F3 | US20140161822, US20140248286, WO2014078268 SEQ ID NO: 166 | 4913 |
| INFL777 | Light chain variable region | 23.06C2 | US20140161822, US20140248286, WO2014078268 SEQ ID NO: 170 | 4914 |
| INFL778 | Light chain variable region | 39.29 | US20140161822, US20140248286, WO2014078268 SEQ ID NO: 235 | 4915 |
| INFL779 | Light chain variable region | F16 Variant 3 | WO2013011347, US20140271655, U.S. Pat. No. 8,871,207 SEQ ID NO: 57 | 4916 |
| INFL780 | Light chain variable region | F16 Variant 5 | WO2013011347, US20140271655, U.S. Pat. No. 8,871,207 SEQ ID NO: 61 | 4917 |
| INFL781 | Light chain variable region | FC41 | WO2010010467 SEQ ID NO 61 | 4918 |
| INFL782 | Light chain variable region | FE43 | WO2010010467 SEQ ID NO 75 | 4919 |
| INFL783 | Light chain variable region | FB75, FB110, FB177 | WO2010010467 SEQ ID NO 122 | 4920 |
| INFL784 | Light chain variable region | FB17 | WO2010010467 SEQ ID NO 106 | 4921 |
| INFL785 | Light chain variable region | FC6 | WO2010010467 SEQ ID NO 46 | 4922 |
| INFL786 | Light chain variable region | FE53 | WO2010010467 SEQ ID NO 90 | 4923 |
| INFL787 | Light chain variable region | 7A7 | WO2010138564 SEQ ID NO: 7 | 4924 |

TABLE 21-continued

Antibodies against Influenza virus

| Antibody No. | Description | Antibody Name | Reference Information | SEQ ID NO |
|---|---|---|---|---|
| INFL788 | Light chain variable region | 12DI | WO2010138564 SEQ ID NO: 13 | 4925 |
| INFL789 | Light chain variable region | 66A6 | WO2010138564 SEQ ID NO: 17 | 4926 |
| INFL790 | Light chain variable region | B-1 | U.S. Pat. No. 8,975,378, US20110319600, WO2010073647 SEQ ID NO: 28 | 4927 |
| INFL791 | Light chain variable region | D1 | U.S. Pat. No. 8,975,378, US20110319600, WO2010073647 SEQ ID NO: 30 | 4928 |
| INFL792 | Light chain variable region | E-2 | U.S. Pat. No. 8,975,378, US20110319600, WO2010073647 SEQ ID NO: 32 | 4929 |
| INFL793 | Light chain variable region | B-3 | U.S. Pat. No. 8,975,378, US20110319600, WO2010073647 SEQ ID NO: 34 | 4930 |
| INFL794 | Light chain variable region | 5A7 | WO2013114885, US20140377262 SEQ ID NO: 35 | 4931 |
| INFL795 | Light chain variable region | 3A2 | WO2013114885, US20140377262 SEQ ID NO: 39 | 4932 |
| INFL796 | Light chain variable region | 10C4 | WO2013114885, US20140377262 SEQ ID NO: 43 | 4933 |
| INFL797 | Light chain variable region | Fab49 | WO2009144667, US20110076265 SEQ ID NO: 2 | 4934 |
| INFL798 | Light chain variable region | Fab28, IgG PN-SIA28 | WO2009115972, WO2011117848, US20110014187 SEQ ID NO: 2 | 4935 |
| INFL799 | Light chain variable region | TCN-522 | US20120207760, U.S. Pat. No. 8,916,160 SEQ ID NO: 778; U.S. Pat. No. 8,900,590 SEQ ID NO: 33 | 4936 |
| INFL800 | Light chain variable region | CR8018 | WO2010130636 SEQ ID NO: 24 | 4937 |
| INFL801 | Light chain variable region | CR8019 | WO2010130636 SEQ ID NO: 28 | 4938 |
| INFL802 | Light chain variable region | CR8020 | WO2010130636 SEQ ID NO: 32 | 4939 |
| INFL803 | Light chain variable region | CR8021 | WO2010130636 SEQ ID NO: 36 | 4940 |
| INFL804 | Light chain variable region | CR8038 | WO2010130636 SEQ ID NO: 40 | 4941 |
| INFL805 | Light chain variable region | CR8039 | WO2010130636 SEQ ID NO: 44 | 4942 |
| INFL806 | Light chain variable region | CR8040 | WO2010130636 SEQ ID NO: 48 | 4943 |
| INFL807 | Light chain variable region | CR8041 | WO2010130636 SEQ ID NO: 52 | 4944 |
| INFL808 | Light chain variable region | CR8043 | WO2010130636 SEQ ID NO: 56 | 4945 |
| INFL809 | Light chain variable region | CR8049 | WO2010130636 SEQ ID NO: 59 | 4946 |
| INFL810 | Light chain variable region | CR8050 | WO2010130636 SEQ ID NO: 63 | 4947 |
| INFL811 | Light chain variable region | CR8052 | WO2010130636 SEQ ID NO: 67 | 4948 |
| INFL812 | Light chain variable region | CR8055 | WO2010130636 SEQ ID NO: 71 | 4949 |
| INFL813 | Light chain variable region | CR8057 | WO2010130636 SEQ ID NO: 75 | 4950 |
| INFL814 | Light chain variable region | CR8069 | WO2010130636 SEQ ID NO: 79 | 4951 |
| INFL815 | Light chain variable region | CR6255 | US20090311265, U.S. Pat. No. 8,691,223, U.S. Pat. No. 9,109,017, WO2008028946 SEQ ID NO: 85 | 4952 |
| INFL816 | Light chain variable region | CR6257 | US20090311265, U.S. Pat. No. 8,691,223, U.S. Pat. No. 9,109,017, WO2008028946 SEQ ID NO: 87 | 4953 |
| INFL817 | Light chain variable region | CR6260 | US20090311265, U.S. Pat. No. 8,691,223, U.S. Pat. No. 9,109,017, WO2008028946 SEQ ID NO: 89 | 4954 |
| INFL818 | Light chain variable region | CR6261 | US20090311265, U.S. Pat. No. 8,691,223, U.S. Pat. No. 9,109,017, WO2008028946 SEQ ID NO: 91 | 4955 |
| INFL819 | Light chain variable region | CR6262 | US20090311265, U.S. Pat. No. 8,691,223, U.S. Pat. No. 9,109,017, WO2008028946 SEQ ID NO: 93 | 4956 |
| INFL820 | Light chain variable region | CR6268 | US20090311265, U.S. Pat. No. 8,691,223, U.S. Pat. No. 9,109,017, WO2008028946 SEQ ID NO: 95 | 4957 |

TABLE 21-continued

Antibodies against Influenza virus

| Antibody No. | Description | Antibody Name | Reference Information | SEQ ID NO |
|---|---|---|---|---|
| INFL821 | Light chain variable region | CR6307 | US20090311265, U.S. Pat. No. 8,691,223, U.S. Pat. No. 9,109,017, WO2008028946 SEQ ID NO: 97 | 4958 |
| INFL822 | Light chain variable region | CR6310 | US20090311265, U.S. Pat. No. 8,691,223, U.S. Pat. No. 9,109,017, WO2008028946 SEQ ID NO: 99 | 4959 |
| INFL823 | Light chain variable region | CR6314 | US20090311265, U.S. Pat. No. 8,691,223, U.S. Pat. No. 9,109,017, WO2008028946 SEQ ID NO: 101 | 4960 |
| INFL824 | Light chain variable region | CR6323 | US20090311265, U.S. Pat. No. 8,691,223, U.S. Pat. No. 9,109,017, WO2008028946 SEQ ID NO: 103 | 4961 |
| INFL825 | Light chain variable region | CR6325 | US20090311265, U.S. Pat. No. 8,691,223, U.S. Pat. No. 9,109,017, WO2008028946 SEQ ID NO: 105 | 4962 |
| INFL826 | Light chain variable region | CR6331 | US20090311265, U.S. Pat. No. 8,691,223, U.S. Pat. No. 9,109,017, WO2008028946 SEQ ID NO: 107 | 4963 |
| INFL827 | Light chain variable region | CR6344 | US20090311265, U.S. Pat. No. 8,691,223, U.S. Pat. No. 9,109,017, WO2008028946 SEQ ID NO: 109 | 4964 |
| INFL828 | Light chain variable region | CR6141 | US20090311265, U.S. Pat. No. 8,691,223, U.S. Pat. No. 9,109,017, WO2008028946 SEQ ID NO: 319 | 4965 |
| INFL829 | Light chain variable region | CR6272 | US20090311265, U.S. Pat. No. 8,691,223, U.S. Pat. No. 9,109,017, WO2008028946 SEQ ID NO: 323 | 4966 |
| INFL830 | Light chain variable region | CR6296 | US20090311265, U.S. Pat. No. 8,691,223, U.S. Pat. No. 9,109,017, WO2008028946 SEQ ID NO: 327 | 4967 |
| INFL831 | Light chain variable region | CR6301 | US20090311265, U.S. Pat. No. 8,691,223, U.S. Pat. No. 9,109,017, WO2008028946 SEQ ID NO: 331 | 4968 |
| INFL832 | Light chain variable region | CR6327 | US20090311265, U.S. Pat. No. 8,691,223, U.S. Pat. No. 9,109,017, WO2008028946 SEQ ID NO: 335 | 4969 |
| INFL833 | Light chain variable region | CR6328 | US20090311265, U.S. Pat. No. 8,691,223, U.S. Pat. No. 9,109,017, WO2008028946 SEQ ID NO: 339 | 4970 |
| INFL834 | Light chain variable region | CR6329 | US20090311265, U.S. Pat. No. 8,691,223, U.S. Pat. No. 9,109,017, WO2008028946 SEQ ID NO: 343 | 4971 |
| INFL835 | Light chain variable region | CR6332 | US20090311265, U.S. Pat. No. 8,691,223, U.S. Pat. No. 9,109,017, WO2008028946 SEQ ID NO: 347 | 4972 |
| INFL836 | Light chain variable region | CR6334 | US20090311265, U.S. Pat. No. 8,691,223, U.S. Pat. No. 9,109,017, WO2008028946 SEQ ID NO: 351 | 4973 |
| INFL837 | Light chain variable region | CR6336 | US20090311265, U.S. Pat. No. 8,691,223, U.S. Pat. No. 9,109,017, WO2008028946 SEQ ID NO: 355 | 4974 |
| INFL838 | Light chain variable region | CR6339 | US20090311265, U.S. Pat. No. 8,691,223, U.S. Pat. No. 9,109,017, WO2008028946 SEQ ID NO: 359 | 4975 |
| INFL839 | Light chain variable region | CR6342 | US20090311265, U.S. Pat. No. 8,691,223, U.S. Pat. No. 9,109,017, WO2008028946 SEQ ID NO: 363 | 4976 |
| INFL840 | Light chain variable region | CR6343 | US20090311265, U.S. Pat. No. 8,691,223, U.S. Pat. No. 9,109,017, WO2008028946 SEQ ID NO: 367 | 4977 |
| INFL841 | Light chain variable region | CR9003 | US20140120113 SEQ ID NO: 4 | 4978 |
| INFL842 | Light chain variable region | CR9004 | US20140120113 SEQ ID NO: 8 | 4979 |
| INFL843 | Light chain variable region | CR9005 | US20140120113 SEQ ID NO: 12 | 4980 |
| INFL844 | Light chain variable region | CR9006 | US20140120113 SEQ ID NO: 16 | 4981 |
| INFL845 | Light chain variable region | CR9007 | US20140120113 SEQ ID NO: 20 | 4982 |
| INFL846 | Light chain variable region | CR9008 | US20140120113 SEQ ID NO: 24 | 4983 |
| INFL847 | Light chain variable region | CR9009 | US20140120113 SEQ ID NO: 28 | 4984 |

TABLE 21-continued

Antibodies against Influenza virus

| Antibody No. | Description | Antibody Name | Reference Information | SEQ ID NO |
|---|---|---|---|---|
| INFL848 | Light chain variable region | CR9010 | US20140120113 SEQ ID NO: 32 | 4985 |
| INFL849 | Light chain variable region | CR9011 | US20140120113 SEQ ID NO: 36 | 4986 |
| INFL850 | Light chain variable region | CR9012 | US20140120113 SEQ ID NO: 40 | 4987 |
| INFL851 | Light chain variable region | CR9029 | US20140120113 SEQ ID NO: 44 | 4988 |
| INFL852 | Light chain variable region | CR9030 | US20140120113 SEQ ID NO: 48 | 4989 |
| INFL853 | Light chain variable region | CR9031 | US20140120113 SEQ ID NO: 52 | 4990 |
| INFL854 | Light chain variable region | CR9112 | US20140120113 SEQ ID NO: 56 | 4991 |
| INFL855 | Light chain variable region | CR9113 | US20140120113 SEQ ID NO: 60 | 4992 |
| INFL856 | Light chain variable region | CR9114 | US20140120113 SEQ ID NO: 64 | 4993 |
| INFL857 | Light chain variable region | CR8033 | U.S. Pat. No. 8,852,595 SEQ ID NO: 73 | 4994 |
| INFL858 | Light chain variable region | CR8059 | U.S. Pat. No. 8,852,595 SEQ ID NO: 77 | 4995 |
| INFL859 | Light chain variable region | CR8071 | U.S. Pat. No. 8,852,595 SEQ ID NO: 79 | 4996 |
| INFL860 | Light chain variable region | CR10051 | U.S. Pat. No. 8,852,595 SEQ ID NO: 83 | 4997 |
| INFL861 | Light chain variable region | CR10049 | U.S. Pat. No. 8,852,595 SEQ ID NO: 87 | 4998 |
| INFL862 | Light chain variable region | CR10023 | U.S. Pat. No. 8,852,595 SEQ ID NO: 91 | 4999 |
| INFL863 | Light chain variable region | CR10032 | U.S. Pat. No. 8,852,595 SEQ ID NO: 95 | 5000 |
| INFL864 | Light chain variable region | CR11035 | U.S. Pat. No. 8,852,595 SEQ ID NO: 103 | 5001 |
| INFL865 | Light chain variable region | CR11036 | U.S. Pat. No. 8,852,595 SEQ ID NO: 107 | 5002 |
| INFL866 | Light chain variable region | CR11038 | U.S. Pat. No. 8,852,595 SEQ ID NO: 111 | 5003 |
| INFL867 | Light chain variable region | CR11039 | U.S. Pat. No. 8,852,595 SEQ ID NO: 115 | 5004 |
| INFL868 | Light chain variable region | CR8031 | U.S. Pat. No. 8,852,595 SEQ ID NO: 121 | 5005 |
| INFL869 | Light chain variable region | CR8032 | U.S. Pat. No. 8,852,595 SEQ ID NO: 125 | 5006 |
| INFL870 | Light chain variable region | CR8034 | U.S. Pat. No. 8,852,595 SEQ ID NO: 129 | 5007 |
| INFL871 | Light chain variable region | | U.S. Pat. No. 8,992,929 SEQ ID NO: 2 | 5008 |
| INFL872 | Light chain variable region | M2e | U.S. Pat. No. 8,420,794 SEQ ID NO: 1 | 5009 |
| INFL873 | Light chain variable region | | U.S. Pat. No. 8,715,743, US20140275492 SEQ ID NO: 16 | 5010 |
| INFL874 | Light chain variable region | | U.S. Pat. No. 8,715,743, US20140275492 SEQ ID NO: 19 | 5011 |
| INFL875 | Light chain variable region | | U.S. Pat. No. 8,715,743, US20140275492 SEQ ID NO: 32 | 5012 |
| INFL876 | Light chain variable region | anti-1918 influenza HA Ig | Yu, X., et al., Neutralizing antibodies derived from the B cells of 1918 influenza pandemic survivors; Nature 455 (7212), 532-536 (2008), NCBI Accession #ACI04582.1 (121aa) | 5013 |
| INFL877 | Light chain variable region | anti-1918 influenza HA Ig | Yu, X., et al., Neutralizing antibodies derived from the B cells of 1918 influenza pandemic survivors; Nature 455 (7212), 532-536 (2008), NCBI Accession #ACI04580.1 (118aa) | 5014 |
| INFL878 | Light chain variable region | 4D20 | Yu, X. et al "Neutralizing antibodies derived from the B cells of 1918 influenza pandemic survivors", Nature 455 (7212), 532-536, NCBI Accession #ACI04580 | 5015 |
| INFL879 | Light chain variable region | 2B12 | Yu, X. et al "Neutralizing antibodies derived from the B cells of 1918 influenza pandemic survivors", Nature | 5016 |

TABLE 21-continued

Antibodies against Influenza virus

| Antibody No. | Description | Antibody Name | Reference Information | SEQ ID NO |
|---|---|---|---|---|
| | | | 455 (7212), 532-536, NCBI Accession #ABY48869 | |
| INFL880 | Light chain variable region | TCN-535 (5246_P19) | US20150086555 SEQ ID NO: 180 | 5017 |
| INFL881 | Light chain variable region | TCN-536 (5095_N01) | US20150086555 SEQ ID NO: 191 | 5018 |
| INFL882 | Light chain variable region | TCN-537 (3194_D21) | US20150086555 SEQ ID NO: 202 | 5019 |
| INFL883 | Light chain variable region | TCN-538 (3206_O17) | US20150086555 SEQ ID NO: 214 | 5020 |
| INFL884 | Light chain variable region | TCN-539 (5056_A08) | US20150086555 SEQ ID NO: 226 | 5021 |
| INFL885 | Light chain variable region | TCN-540 (5060_F05) | US20150086555 SEQ ID NO: 238 | 5022 |
| INFL886 | Light chain variable region | TCN-541 (5062_M11) | US20150086555 SEQ ID NO: 250 | 5023 |
| INFL887 | Light chain variable region | TCN-542 (5079_A16) | US20150086555 SEQ ID NO: 262 | 5024 |
| INFL888 | Light chain variable region | TCN-543 (5081_G23) | US20150086555 SEQ ID NO: 274 | 5025 |
| INFL889 | Light chain variable region | TCN-544 (5082_A19) | US20150086555 SEQ ID NO: 286 | 5026 |
| INFL890 | Light chain variable region | TCN-545 (5082_I15) | US20150086555 SEQ ID NO: 298 | 5027 |
| INFL891 | Light chain variable region | TCN-546 (5089_L08) | US20150086555 SEQ ID NO: 309 | 5028 |
| INFL892 | Light chain variable region | TCN-547 (5092_F11) | US20150086555 SEQ ID NO: 320 | 5029 |
| INFL893 | Light chain variable region | TCN-548 (5092_P01) | US20150086555 SEQ ID NO: 331 | 5030 |
| INFL894 | Light chain variable region | TCN-549 (5092_P04) | US20150086555 SEQ ID NO: 342 | 5031 |
| INFL895 | Light chain variable region | TCN-550 (5096_F06) | US20150086555 SEQ ID NO: 353 | 5032 |
| INFL896 | Light chain variable region | TCN-551 (5243_D01) | US20150086555 SEQ ID NO: 365 | 5033 |
| INFL897 | Light chain variable region | TCN-552 (5249_I23) | US20150086555 SEQ ID NO: 377 | 5034 |
| INFL898 | Light chain variable region | TCN-553 (5261_C18) | US20150086555 SEQ ID NO: 389 | 5035 |
| INFL899 | Light chain variable region | TCN-554 (5277_M05) | US20150086555 SEQ ID NO: 399 | 5036 |
| INFL900 | Light chain variable region | TCN-555 (5246_L16) | US20150086555 SEQ ID NO: 405 | 5037 |
| INFL901 | Light chain variable region | TCN-556 (5089_K12) | US20150086555 SEQ ID NO: 415 | 5038 |
| INFL902 | Light chain variable region | TCN-557 (5081_A04) | US20150086555 SEQ ID NO: 427 | 5039 |
| INFL903 | Light chain variable region | TCN-559 (5097_G08) | US20150086555 SEQ ID NO: 441 | 5040 |
| INFL904 | Light chain variable region | TCN-560 (5084_P10) | US20150086555 SEQ ID NO: 453 | 5041 |
| INFL905 | Light chain variable region | TCN-564 (5256_A17b) | US20150086555 SEQ ID NO: 519 | 5042 |
| INFL906 | Light chain variable region | CR8001 | WO2010130636 SEQ ID NO: 4 | 5043 |
| INFL907 | Light chain variable region | CR8003 | WO2010130636 SEQ ID NO: 8 | 5044 |
| INFL908 | Light chain variable region | CR8015 | WO2010130636 SEQ ID NO: 12 | 5045 |
| INFL909 | Light chain variable region | CR8016 | WO2010130636 SEQ ID NO: 16 | 5046 |
| INFL910 | Light chain variable region | CR8017 | WO2010130636 SEQ ID NO: 20 | 5047 |
| INFL911 | Light chain variable region | TCN-522 (3212_I12) | US20150086555 SEQ ID NO: 40 | 5048 |
| INFL912 | Light chain variable region | TCN-521 (3280_D18) | US20150086555 SEQ ID NO: 28 | 5049 |
| INFL913 | Light chain variable region | TCN-523 (5248_A17), TCN-533 (5256_A17a), TCN-534 (5249_B02) | US20150086555 SEQ ID NO: 52 | 5050 |

TABLE 21-continued

Antibodies against Influenza virus

| Antibody No. | Description | Antibody Name | Reference Information | SEQ ID NO |
|---|---|---|---|---|
| INFL914 | Light chain variable region | TCN-563 (5237_B21) | US20150086555 SEQ ID NO: 64 | 5051 |
| INFL915 | Light chain variable region | TCN-526 (5084_C17) | US20150086555 SEQ ID NO: 76 | 5052 |
| INFL916 | Light chain variable region | TCN-527 (5086_C06) | US20150086555 SEQ ID NO: 88 | 5053 |
| INFL917 | Light chain variable region | TCN-528 (5087_P17) | US20150086555 SEQ ID NO: 100 | 5054 |
| INFL918 | Light chain variable region | TCN-529 (5297_H01) | US20150086555 SEQ ID NO: 112 | 5055 |
| INFL919 | Light chain variable region | TCN-530 (5248_H10), TCN-558 (5248_H10b) | US20150086555 SEQ ID NO: 124 | 5056 |
| INFL920 | Light chain variable region | TCN-531 (5091_H13) | US20150086555 SEQ ID NO: 136 | 5057 |
| INFL921 | Light chain variable region | TCN-532 (5262_H18) | US20150086555 SEQ ID NO: 148 | 5058 |
| INFL922 | Light chain variable region | TCN-534 (5249_B02) | US20150086555 SEQ ID NO: 168 | 5059 |
| INFL923 | Light chain variable region | TCN-504 (3251_K17) | US20150086555 SEQ ID NO: 524 | 5060 |
| INFL924 | Light chain variable region | AB1 | US20120093834, WO2009121004 SEQ ID NO: 71 | 5061 |
| INFL925 | Light chain variable region | AB2 | US20120093834, WO2009121004 SEQ ID NO: 140 | 5062 |
| INFL926 | Light chain variable region | AB3 | US20120093834, WO2009121004 SEQ ID NO: 81 | 5063 |
| INFL927 | Light chain variable region | AB4 | US20120093834, WO2009121004 SEQ ID NO: 158 | 5064 |
| INFL928 | Light chain variable region | AB5 | US20120093834, WO2009121004 SEQ ID NO: 159 | 5065 |
| INFL929 | Light chain variable region | AB6 | US20120093834, WO2009121004 SEQ ID NO: 160 | 5066 |
| INFL930 | Light chain variable region | VN04-2 | WO2008033105 SEQ ID NO: 6 | 5067 |
| INFL931 | Light chain variable region | VN04-3 | WO2008033105 SEQ ID NO: 8 | 5068 |
| INFL932 | Light chain variable region | 1286-C05 | WO2010132604, US20120128671 SEQ ID NO: 3 | 5069 |
| INFL933 | Light chain variable region | 1286-C05 | WO2010132604, US20120128671 SEQ ID NO: 4 | 5070 |
| INFL934 | Light chain variable region | 1286-C05 | WO2010132604, US20120128671 SEQ ID NO: 5 | 5071 |
| INFL935 | Light chain variable region | 1286-A11 | WO2010132604, US20120128671 SEQ ID NO: 6 | 5072 |
| INFL936 | Light chain variable region mouse IgG | IA2 | WO2015028478 SEQ ID NO: 3 | 5073 |
| INFL937 | Light chain variable region mouse IgG | 7B8 | WO2015028478 SEQ ID NO: 5 | 5074 |
| INFL938 | Light chain variable region, partial | monoclonal antibody TCN-031 | U.S. Pat. No. 8,900,590, US2012039899, Grandea, A. G. et al., Human antibodies reveal a protective epitope that is highly conserved among human and nonhuman influenza A viruses; Proc. Natl. Acad. Set. U.S.A. 107 (28), 12658-12663 (2010), NCBI Accession #ADK23871.1 (106aa) | 5075 |
| INFL939 | Light chain variable region, partial | monoclonal antibody TCN-032 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23870.1 (107aa) | 5076 |
| INFL940 | Light chain variable region, partial | monoclonal antibody 3362_B11 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession # ADK23886.1 (107aa) | 5077 |

TABLE 21-continued

Antibodies against Influenza virus

| Antibody No. | Description | Antibody Name | Reference Information | SEQ ID NO |
|---|---|---|---|---|
| INFL941 | Light chain variable region, partial | monoclonal antibody 3260_D19 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23885.1 (106aa) | 5078 |
| INFL942 | Light chain variable region, partial | monoclonal antibody 3253_P10 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23884.1(107aa) | 5079 |
| INFL943 | Light chain variable region, partial | monoclonal antibody 3248_P18 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23883.1 (106aa) | 5080 |
| INFL944 | Light chain variable region, partial | monoclonal antibody 3139_P23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23882.1(107aa) | 5081 |
| INFL945 | Light chain variable region, partial | monoclonal antibody 3420_I23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23881.1(108aa) | 5082 |
| INFL946 | Light chain variable region, partial | monoclonal antibody 3255_J06 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23880.1(108aa) | 5083 |
| INFL947 | Light chain variable region, partial | monoclonal antibody 3252_C13 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23879.1 (108aa) | 5084 |
| INFL948 | Light chain variable region, partial | monoclonal antibody 3136_G05 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23878.1 (108aa) | 5085 |
| INFL949 | Light chain variable region, partial | monoclonal antibody 3244_H04 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23877.1 (107aa) | 5086 |
| INFL950 | Light chain variable region, partial | monoclonal antibody 3245_O19 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23876.1 (107aa) | 5087 |
| INFL951 | Light chain variable region, partial | monoclonal antibody 3259_J21 | Grandea, A. G. et al., Human antibodies reveal a protective epitope that is highly conserved among human and nonhuman influenza A viruses; Proc. Natl. Acad. | 5088 |

TABLE 21-continued

Antibodies against Influenza virus

| Antibody No. | Description | Antibody Name | Reference Information | SEQ ID NO |
|---|---|---|---|---|
| INFL952 | Light chain variable region, partial | monoclonal antibody 3243_J07 | Sci. U.S.A. 107 (28), 12658-12663 (2010), NCBI Accession #ADK23875.1 (107aa)<br>Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23874.1 (108aa) | 5089 |
| INFL953 | Light chain variable region, partial | monoclonal antibody 3244_I10 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23873.1 (108aa) | 5090 |
| INFL954 | Light chain variable region, partial | monoclonal antibody 3241_G23 | Grandea, A. G. et al., Human antibodies reveal a protective epitope that is highly conserved among human and nonhuman influenza A viruses; Proc. Natl. Acad. Sci. U.S.A. 107 (28), 12658-12663 (2010), NCBI Accession #ADK23872.1 (108aa) | 5091 |
| INFL955 | Light chain variable region, partial | 100F4-LV | Hu, H., et al., A Human Antibody Recognizing a Conserved Epitope of H5 Hemagglutinin Broadly Neutralizes Highly Pathogenic Avian Influenza H5N1 Viruses; J. Virol. 86 (6), 2978-2989 (2012), NCBI Accession #AEL30604.1 (112aa) | 5092 |
| INFL956 | Light Chain, Fab Fragment | ch65 | Whittle, J. R. et al., Broadly neutralizing human antibody that recognizes the receptor-binding pocket of influenza virus hemagglutinin; Proc. Natl. Acad. Sci. U.S.A. 108 (34), 14216-14221 (2011), NCBI Accession #3SM5_L | 5093 |
| INFL957 | Light chain | 1I20 | WO2010127252, U.S. Pat. No. 8,894,997 SEQ ID NO: 6 | 5094 |
| INFL958 | Light chain | | WO2010127252, U.S. Pat. No. 8,894,997 SEQ ID NO: 12 | 5095 |
| INFL959 | Monoclonal antibody heavy chain | Neutralizing Human Monoclonal Antibody With 1968 H3 Ha | Wu, Y. et al., A potent broad-spectrum protective human monoclonal antibody crosslinking two hemagglutinin monomers of influenza A virus; Nat Commun 6, 7708 (2015), NCBI Accession #4UBD_C | 5096 |
| INFL960 | Monoclonal antibody light chain | Neutralizing Human Monoclonal Antibody With 1968 H3 Ha | Wu, Y. et al., A potent broad-spectrum protective human monoclonal antibody crosslinking two hemagglutinin monomers of influenza A virus; Nat Commun 6, 7708 (2015), NCBI Accession #4UBD_D | 5097 |
| INFL961 | Mutated heavy chain variable | 8G9 mutated | U.S. Pat. No. 8,603,467 SEQ ID NO: 42 | 5098 |
| INFL962 | Mutated heavy chain variable (VH-LV) | 13D4 mutated | U.S. Pat. No. 8,603,467 SEQ ID NO: 46 | 5099 |
| INFL963 | Mutated heavy chain variable (VH-SV) | 13D4 mutated | U.S. Pat. No. 8,603,467 SEQ ID NO: 44 | 5100 |
| INFL964 | Nanobody | 202-C8 | US20110182897, WO2009147248 SEQ ID NO: 138 | 5101 |
| INFL965 | Nanobody | 203-B12 | US20110182897, WO2009147248 SEQ ID NO: 2439 | 5102 |
| INFL966 | Nanobody | 203-H9 | US20110182897, WO2009147248 SEQ ID NO: 2445 | 5103 |
| INFL967 | Scfv | JM7_B-G7 | WO2012072788 SEQ ID NO: 7 | 5104 |
| INFL968 | Scfv | JM7_S-F8 | WO2012072788 SEQ ID NO: 15 | 5105 |
| INFL969 | Scfv | JM7JH-F1 | WO2012072788 SEQ ID NO: 17 | 5106 |
| INFL970 | Scfv | JM7_S-A9 | WO2012072788 SEQ ID NO: 19 | 5107 |
| INFL971 | Scfv | JM7_S-A10 | WO2012072788 SEQ ID NO: 21 | 5108 |
| INFL972 | Scfv | JM7_B-H | WO2012072788 SEQ ID NO: 23 | 5109 |
| INFL973 | Scfv | JM6_SC-H1 | WO2012072788 SEQ ID NO: 25 | 5110 |
| INFL974 | Scfv | jM6_SC_D3 | WO2012072788 SEQ ID NO: 27 | 5111 |

TABLE 21-continued

Antibodies against Influenza virus

| Antibody No. | Description | Antibody Name | Reference Information | SEQ ID NO |
|---|---|---|---|---|
| INFL975 | Scfv | H2526 | Schmidt, A. G. et al., Viral receptor-binding site antibodies with diverse germline origins; Cell 161 (5), 1026-1034 (2015), NCBI Accession #4YJZ_L | 5112 |
| INFL976 | Scfv fragment | AVC4 | WO2010040572A2 FIG. 6 | 5113 |
| INFL977 | Scfv fragment | AVD1 | WO2010040572A2 FIG. 8 | 5114 |
| INFL978 | Scfv fragment | AVE2 | WO2010040572A2 FIG. 10 | 5115 |
| INFL979 | Scfv fragment | AVA6 | WO2010040572A2 FIG. 12 | 5116 |
| INFL980 | Scfv fragment | AVG4 | WO2010040572A2 FIG. 14 | 5117 |
| INFL981 | Scfv heavy chain variable region | SC06-141 | US20150104459 SEQ ID NO: 309 | 5118 |
| INFL982 | Scfv heavy chain variable region | SC06-255 | US20150104459 SEQ ID NO: 313 | 5119 |
| INFL983 | Scfv heavy chain variable region | SC06-257 | US20150104459 SEQ ID NO: 317 | 5120 |
| INFL984 | Scfv heavy chain variable region | SC6-260 | US20150104459 SEQ ID NO: 321 | 5121 |
| INFL985 | Scfv heavy chain variable region | SC06-261 | US20150104459 SEQ ID NO: 325 | 5122 |
| INFL986 | Scfv heavy chain variable region | SC06-262 | US20150104459 SEQ ID NO: 329 | 5123 |
| INFL987 | Scfv heavy chain variable region | SC06-268 | US20150104459 SEQ ID NO: 333 | 5124 |
| INFL988 | Scfv heavy chain variable region | SC06-272 | US20150104459 SEQ ID NO: 337 | 5125 |
| INFL989 | Scfv heavy chain variable region | SC06-296 | US20150104459 SEQ ID NO: 341 | 5126 |
| INFL990 | Scfv heavy chain variable region | SC06-301 | US20150104459 SEQ ID NO: 345 | 5127 |
| INFL991 | Scfv heavy chain variable region | SC06-307 | US20150104459 SEQ ID NO: 349 | 5128 |
| INFL992 | Scfv heavy chain variable region | SC06-310 | US20150104459 SEQ ID NO: 353 | 5129 |
| INFL993 | Scfv heavy chain variable region | SC06-314 | US20150104459 SEQ ID NO: 357 | 5130 |
| INFL994 | Scfv heavy chain variable region | SC06-323 | US20150104459 SEQ ID NO: 361 | 5131 |
| INFL995 | Scfv heavy chain variable region | SC06-325 | US20150104459 SEQ ID NO: 365 | 5132 |
| INFL996 | Scfv heavy chain variable region | SC06-327 | US20150104459 SEQ ID NO: 369 | 5133 |
| INFL997 | Scfv heavy chain variable region | SC06-328 | US20150104459 SEQ ID NO: 373 | 5134 |
| INFL998 | Scfv heavy chain variable region | SC06-329 | US20150104459 SEQ ID NO: 377 | 5135 |
| INFL999 | Scfv heavy chain variable region | SC06-331 | US20150104459 SEQ ID NO: 381 | 5136 |
| INFL1000 | Scfv heavy chain variable region | SC06-332 | US20150104459 SEQ ID NO: 385 | 5137 |
| INFL1001 | Scfv heavy chain variable region | SC06-334 | US20150104459 SEQ ID NO: 389 | 5138 |
| INFL1002 | Scfv heavy chain variable region | SC06-336 | US20150104459 SEQ ID NO: 393 | 5139 |
| INFL1003 | Scfv heavy chain variable region | SC06-339 | US20150104459 SEQ ID NO: 397 | 5140 |
| INFL1004 | Scfv heavy chain variable region | SC06-342 | US20150104459 SEQ ID NO: 401 | 5141 |
| INFL1005 | Scfv heavy chain variable region | SC06-343 | US20150104459 SEQ ID NO: 405 | 5142 |
| INFL1006 | Scfv heavy chain variable region | SC06-344 | US20150104459 SEQ ID NO: 409 | 5143 |
| INFL1007 | Scfv heavy chain variable region | CR6255 | US20150104459 SEQ ID NO: 417 | 5144 |
| INFL1008 | Scfv heavy chain variable region | CR6257 | US20150104459 SEQ ID NO: 423 | 5145 |
| INFL1009 | Scfv heavy chain variable region | CR6260 | US20150104459 SEQ ID NO: 429 | 5146 |
| INFL1010 | Scfv heavy chain variable region | CR6261 | US20150104459 SEQ ID NO: 435 | 5147 |
| INFL1011 | Scfv heavy chain variable region | CR6262 | US20150104459 SEQ ID NO: 441 | 5148 |
| INFL1012 | Scfv heavy chain variable region | CR6268 | US20150104459 SEQ ID NO: 447 | 5149 |

TABLE 21-continued

Antibodies against Influenza virus

| Antibody No. | Description | Antibody Name | Reference Information | SEQ ID NO |
|---|---|---|---|---|
| INFL1013 | Scfv heavy chain variable region | CR6272 | US20150104459 SEQ ID NO: 453 | 5150 |
| INFL1014 | Scfv heavy chain variable region | CR696 | US20150104459 SEQ ID NO: 459 | 5151 |
| INFL1015 | Scfv heavy chain variable region | CR6301 | US20150104459 SEQ ID NO: 465 | 5152 |
| INFL1016 | Scfv heavy chain variable region | CR6307 | US20150104459 SEQ ID NO: 471 | 5153 |
| INFL1017 | Scfv heavy chain variable region | CR6310 | US20150104459 SEQ ID NO: 477 | 5154 |
| INFL1018 | Scfv heavy chain variable region | CR6314 | US20150104459 SEQ ID NO: 483 | 5155 |
| INFL1019 | Scfv heavy chain variable region | CR6323 | US20150104459 SEQ ID NO: 489 | 5156 |
| INFL1020 | Scfv heavy chain variable region | CR6325 | US20150104459 SEQ ID NO: 495 | 5157 |
| INFL1021 | Scfv heavy chain variable region | CR6327 | US20150104459 SEQ ID NO: 501 | 5158 |
| INFL1022 | Scfv heavy chain variable region | CR6328 | US20150104459 SEQ ID NO: 507 | 5159 |
| INFL1023 | Scfv heavy chain variable region | CR6329 | US20150104459 SEQ ID NO: 513 | 5160 |
| INFL1024 | Scfv heavy chain variable region | CR6331 | US20150104459 SEQ ID NO: 519 | 5161 |
| INFL1025 | Scfv heavy chain variable region | CR6332 | US20150104459 SEQ ID NO: 525 | 5162 |
| INFL1026 | Scfv heavy chain variable region | CR6334 | US20150104459 SEQ ID NO: 531 | 5163 |
| INFL1027 | Scfv heavy chain variable region | CR6336 | US20150104459 SEQ ID NO: 537 | 5164 |
| INFL1028 | Scfv heavy chain variable region | CR6339 | US20150104459 SEQ ID NO: 543 | 5165 |
| INFL1029 | Scfv heavy chain variable region | CR6342 | US20150104459 SEQ ID NO: 550 | 5166 |
| INFL1030 | Scfv heavy chain variable region | CR6343 | US20150104459 SEQ ID NO: 556 | 5167 |
| INFL1031 | Scfv heavy chain variable region | CR6344 | US20150104459 SEQ ID NO: 562 | 5168 |
| INFL1032 | Scfv light chain variable region | SC06-141 | US20150104459 SEQ ID NO: 310 | 5169 |
| INFL1033 | Scfv light chain variable region | SC06-255 | US20150104459 SEQ ID NO: 314 | 5170 |
| INFL1034 | Scfv light chain variable region | SC06-257 | US20150104459 SEQ ID NO: 318 | 5171 |
| INFL1035 | Scfv light chain variable region | SC6-260 | US20150104459 SEQ ID NO: 322 | 5172 |
| INFL1036 | Scfv light chain variable region | SC06-261 | US20150104459 SEQ ID NO: 326 | 5173 |
| INFL1037 | Scfv light chain variable region | SC06-262 | US20150104459 SEQ ID NO: 330 | 5174 |
| INFL1038 | Scfv light chain variable region | SC06-268 | US20150104459 SEQ ID NO: 334 | 5175 |
| INFL1039 | Scfv light chain variable region | SC06-272 | US20150104459 SEQ ID NO: 338 | 5176 |
| INFL1040 | Scfv light chain variable region | SC06-296 | US20150104459 SEQ ID NO: 342 | 5177 |
| INFL1041 | Scfv light chain variable region | SC06-301 | US20150104459 SEQ ID NO: 346 | 5178 |
| INFL1042 | Scfv light chain variable region | SC06-307 | US20150104459 SEQ ID NO: 350 | 5179 |
| INFL1043 | Scfv light chain variable region | SC06-310 | US20150104459 SEQ ID NO: 354 | 5180 |
| INFL1044 | Scfv light chain variable region | SC06-314 | US20150104459 SEQ ID NO: 358 | 5181 |
| INFL1045 | Scfv light chain variable region | SC06-323 | US20150104459 SEQ ID NO: 362 | 5182 |
| INFL1046 | Scfv light chain variable region | SC06-325 | US20150104459 SEQ ID NO: 366 | 5183 |
| INFL1047 | Scfv light chain variable region | SC06-327 | US20150104459 SEQ ID NO: 370 | 5184 |
| INFL1048 | Scfv light chain variable region | SC06-328 | US20150104459 SEQ ID NO: 374 | 5185 |
| INFL1049 | Scfv light chain variable region | SC06-329 | US20150104459 SEQ ID NO: 378 | 5186 |

TABLE 21-continued

Antibodies against Influenza virus

| Antibody No. | Description | Antibody Name | Reference Information | SEQ ID NO |
|---|---|---|---|---|
| INFL1050 | Scfv light chain variable region | SC06-331 | US20150104459 SEQ ID NO: 382 | 5187 |
| INFL1051 | Scfv light chain variable region | SC06-332 | US20150104459 SEQ ID NO: 386 | 5188 |
| INFL1052 | Scfv light chain variable region | SC06-334 | US20150104459 SEQ ID NO: 390 | 5189 |
| INFL1053 | Scfv light chain variable region | SC06-336 | US20150104459 SEQ ID NO: 394 | 5190 |
| INFL1054 | Scfv light chain variable region | SC06-339 | US20150104459 SEQ ID NO: 398 | 5191 |
| INFL1055 | Scfv light chain variable region | SC06-342 | US20150104459 SEQ ID NO: 402 | 5192 |
| INFL1056 | Scfv light chain variable region | SC06-343 | US20150104459 SEQ ID NO: 406 | 5193 |
| INFL1057 | Scfv light chain variable region | SC06-344 | US20150104459 SEQ ID NO: 410 | 5194 |
| INFL1058 | Scfv light chain variable region | CR6141 | US20150104459 SEQ ID NO: 414 | 5195 |
| INFL1059 | Scfv light chain variable region | CR6255 | US20150104459 SEQ ID NO: 420 | 5196 |
| INFL1060 | Scfv light chain variable region | CR6257 | US20150104459 SEQ ID NO: 426 | 5197 |
| INFL1061 | Scfv light chain variable region | CR6260 | US20150104459 SEQ ID NO: 432 | 5198 |
| INFL1062 | Scfv light chain variable region | CR6261 | US20150104459 SEQ ID NO: 438 | 5199 |
| INFL1063 | Scfv light chain variable region | CR6262 | US20150104459 SEQ ID NO: 444 | 5200 |
| INFL1064 | Scfv light chain variable region | CR6268 | US20150104459 SEQ ID NO: 450 | 5201 |
| INFL1065 | Scfv light chain variable region | CR6272 | US20150104459 SEQ ID NO: 456 | 5202 |
| INFL1066 | Scfv light chain variable region | CR696 | US20150104459 SEQ ID NO: 462 | 5203 |
| INFL1067 | Scfv light chain variable region | CR6301 | US20150104459 SEQ ID NO: 468 | 5204 |
| INFL1068 | Scfv light chain variable region | CR6307 | US20150104459 SEQ ID NO: 474 | 5205 |
| INFL1069 | Scfv light chain variable region | CR6310 | US20150104459 SEQ ID NO: 480 | 5206 |
| INFL1070 | Scfv light chain variable region | CR6314 | US20150104459 SEQ ID NO: 486 | 5207 |
| INFL1071 | Scfv light chain variable region | CR6323 | US20150104459 SEQ ID NO: 492 | 5208 |
| INFL1072 | Scfv light chain variable region | CR6325 | US20150104459 SEQ ID NO: 498 | 5209 |
| INFL1073 | Scfv light chain variable region | CR6327 | US20150104459 SEQ ID NO: 504 | 5210 |
| INFL1074 | Scfv light chain variable region | CR6328 | US20150104459 SEQ ID NO: 510 | 5211 |
| INFL1075 | Scfv light chain variable region | CR6329 | US20150104459 SEQ ID NO: 516 | 5212 |
| INFL1076 | Scfv light chain variable region | CR6331 | US20150104459 SEQ ID NO: 522 | 5213 |
| INFL1077 | Scfv light chain variable region | CR6332 | US20150104459 SEQ ID NO: 528 | 5214 |
| INFL1078 | Scfv light chain variable region | CR6334 | US20150104459 SEQ ID NO: 534 | 5215 |
| INFL1079 | Scfv light chain variable region | CR6336 | US20150104459 SEQ ID NO: 540 | 5216 |
| INFL1080 | Scfv light chain variable region | CR6339 | US20150104459 SEQ ID NO: 547 | 5217 |
| INFL1081 | Scfv light chain variable region | CR6342 | US20150104459 SEQ ID NO: 553 | 5218 |
| INFL1082 | Scfv light chain variable region | CR6343 | US20150104459 SEQ ID NO: 559 | 5219 |
| INFL1083 | Scfv light chain variable region | CR6344 | US20150104459 SEQ ID NO: 565 | 5220 |
| INFL1084 | Vhch antibody | 641 I-9 | Schmidt, A. G. et al., Viral receptor-binding site antibodies with diverse germline origins; Cell 161 (5), 1026-1034 (2015), NCBI Accession #4YK4_Z | 5221 |
| INFL1085 | Vlcl antibody | 641 I-9 | Schmidt, A. G. et al., Viral receptor-binding site antibodies with diverse | 5222 |

TABLE 21-continued

Antibodies against Influenza virus

| Antibody No. | Description | Antibody Name | Reference Information | SEQ ID NO |
|---|---|---|---|---|
| | | | germline origins; Cell 161 (5), 1026-1034 (2015), NCBI Accession #4YK4_Y | |

In one embodiment, the payload region of the AAV particle comprises one or more nucleic acid sequences, fragment or variants thereof or encodes one or more polypeptides, fragments or variants thereof described in U.S. Pat. Nos. 8,003,106 and 8,540,995. International Patent Publication No. WO2015028478, WO02012045001. US Publication No. US20150239960 and US20130251715, the contents of each of which are herein incorporated by reference in their entirety, against influenza.

In one embodiment, the payload region of the AAV particle comprises one or more nucleic acid sequences encoding one or more of the payload antibody polypeptides listed in Table 22 against Respiratory Syncytial Virus.

TABLE 22

Antibodies against Respiratory Syncytial Virus

| Antibody No. | Description | Antibody Name | Reference Information | SEQ ID NO |
|---|---|---|---|---|
| RSV1 | Heavy chain variable, F and G Proteins | clone 888 | US20110189171; US7879329SEQ ID NO: 43 | 5223 |
| RSV2 | Heavy chain variable, F and G Proteins | mAb 824 | US20110189171; US7879329 SEQ ID NO: 178 | 5224 |
| RSV3 | Heavy chain variable, F and G Proteins | clone 735 | US20110189171; US7879329 SEQ ID NO: 1 | 5225 |
| RSV4 | Heavy chain variable, F and G Proteins | clone 736 | US20110189171; US7879329 SEQ ID NO: 2 | 5226 |
| RSV5 | Heavy chain variable, F and G Proteins | clone 744 | US20110189171; US7879329 SEQ ID NO: 3 | 5227 |
| RSV6 | Heavy chain variable, F and G Proteins | clone 793 | US20110189171; US7879329 SEQ ID NO: 4 | 5228 |
| RSV7 | Heavy chain variable, F and G Proteins | clone 795 | US20110189171; US7879329 SEQ ID NO: 5 | 5229 |
| RSV8 | Heavy chain variable, F and G Proteins | clone 796 | US2011018917; US7879329 SEQ ID NO: 6 | 5230 |
| RSV9 | Heavy chain variable, F and G Proteins | clone 799 | US20110189171; US7879329 SEQ ID NO: 7 | 5231 |
| RSV10 | Heavy chain variable, F and G Proteins | clone 800 | US20110189171; US7879329 SEQ ID NO: 8 | 5232 |
| RSV11 | Heavy chain variable, F and G Proteins | clone 801 | US20110189171; US7879329 SEQ ID NO: 9 | 5233 |
| RSV12 | Heavy chain variable, F and G Proteins | clone 804 | US20110189171; US7879329 SEQ ID NO: 10 | 5234 |
| RSV13 | Heavy chain variable, F and G Proteins | clone 810 | US20110189171; US7879329 SEQ ID NO: 11 | 5235 |
| RSV14 | Heavy chain variable, F and G Proteins | clone 811 | US20110189171; US7879329 SEQ ID NO: 12 | 5236 |
| RSV15 | Heavy chain variable, F and G Proteins | clone 812 | US20110189171; US7879329 SEQ ID NO: 13 | 5237 |
| RSV16 | Heavy chain variable, F and G Proteins | clone 814 | US20110189171; US7879329 SEQ ID NO: 14 | 5238 |
| RSV17 | Heavy chain variable, F and G Proteins | clone 816 | US20110189171; US7879329 SEQ ID NO: 15 | 5239 |
| RSV18 | Heavy chain variable, F and G Proteins | clone 817 | US20110189171; US7879329 SEQ ID NO: 16 | 5240 |
| RSV19 | Heavy chain variable, F and G Proteins | clone 818 | US20110189171; US7879329 SEQ ID NO: 17 | 5241 |
| RSV20 | Heavy chain variable, F and G Proteins | clone 819 | US20110189171; US7879329 SEQ ID NO: 18 | 5242 |
| RSV21 | Heavy chain variable, F and G Proteins | clone 824 | US20110189171; US7879329 SEQ ID NO: 19 | 5243 |
| RSV22 | Heavy chain variable, F and G Proteins | clone 825 | US20110189171; US7879329 SEQ ID NO: 20 | 5244 |
| RSV23 | Heavy chain variable, F and G Proteins | clone 827 | US20110189171; US7879329 SEQ ID NO: 21 | 5245 |
| RSV24 | Heavy chain variable, F and G Proteins | clone 829 | US20110189171; US7879329 SEQ ID NO: 22 | 5246 |
| RSV25 | Heavy chain variable, F and G Proteins | clone 830 | US20110189171; US7879329 SEQ ID NO: 23 | 5247 |
| RSV26 | Heavy chain variable, F and G Proteins | clone 831 | US20110189171; US7879329 SEQ ID NO: 24 | 5248 |

TABLE 22-continued

Antibodies against Respiratory Syncytial Virus

| Antibody No. | Description | Antibody Name | Reference Information | SEQ ID NO |
|---|---|---|---|---|
| RSV27 | Heavy chain variable, F and G Proteins | clone 835 | US20110189171; US7879329 SEQ ID NO: 25 | 5249 |
| RSV28 | Heavy chain variable, F and G Proteins | clone 838 | US20110189171; US7879329 SEQ ID NO: 26 | 5250 |
| RSV29 | Heavy chain variable, F and G Proteins | clone 841 | US20110189171; US7879329 SEQ ID NO: 27 | 5251 |
| RSV30 | Heavy chain variable, F and G Proteins | clone 853 | US20110189171; US7879329 SEQ ID NO: 28 | 5252 |
| RSV31 | Heavy chain variable, F and G Proteins | clone 855 | US20110189171; US7879329 SEQ ID NO: 29 | 5253 |
| RSV32 | Heavy chain variable, F and G Proteins | clone 856 | US20110189171; US7879329 SEQ ID NO: 30 | 5254 |
| RSV33 | Heavy chain variable, F and G Proteins | clone 857 | US20110189171; US7879329 SEQ ID NO: 31 | 5255 |
| RSV34 | Heavy chain variable, F and G Proteins | clone 858 | US20110189171; US7879329 SEQ ID NO: 32 | 5256 |
| RSV35 | Heavy chain variable, F and G Proteins | clone 859 | US20110189171; US7879329 SEQ ID NO: 33 | 5257 |
| RSV36 | Heavy chain variable, F and G Proteins | clone 861 | US20110189171; US7879329 SEQ ID NO: 34 | 5258 |
| RSV37 | Heavy chain variable, F and G Proteins | clone 863 | US20110189171; US7879329 SEQ ID NO: 35 | 5259 |
| RSV38 | Heavy chain variable, F and G Proteins | clone 868 | US20110189171; US7879329 SEQ ID NO: 36 | 5260 |
| RSV39 | Heavy chain variable, F and G Proteins | clone 870 | US20110189171; US7879329 SEQ ID NO: 37 | 5261 |
| RSV40 | Heavy chain variable, F and G Proteins | clone 871 | US20110189171; US7879329 SEQ ID NO: 38 | 5262 |
| RSV41 | Heavy chain variable, F and G Proteins | clone 880 | US20110189171; US7879329 SEQ ID NO: 39 | 5263 |
| RSV42 | Heavy chain variable, F and G Proteins | clone 881 | US20110189171; US7879329 SEQ ID NO: 40 | 5264 |
| RSV43 | Heavy chain variable, F and G Proteins | clone 884 | US20110189171; US7879329 SEQ ID NO: 41 | 5265 |
| RSV44 | Heavy chain variable, F and G Proteins | clone 886 | US20110189171; US7879329 SEQ ID NO: 42 | 5266 |
| RSV45 | Heavy chain variable, F and G Proteins | clone 894 | US20110189171; US7879329 SEQ ID NO: 44 | 5267 |
| RSV46 | heavy chain variable, F protein of RSV, MPV, or PVM | 3210 variant 1 | WO2013140247 SEQ ID NO: 13 | 5268 |
| RSV47 | heavy chain variable, F protein of RSV, MPV, or PVM | 3210 variant 2, 3210 variant 3, 3210 variant 6 | WO2013140247 SEQ ID NO: 17 | 5269 |
| RSV48 | heavy chain variable, F protein of RSV, MPV, or PVM | 2430 variant 1 | WO2013140247 SEQ ID NO: 29 | 5270 |
| RSV49 | heavy chain variable, F protein of RSV, MPV, or PVM | 2430 variant 2, 2430 variant 5 | WO2013140247 SEQ ID NO: 33 | 5271 |
| RSV50 | heavy chain variable, F protein of RSV, MPV, or PVM | 3210 variant 4, 3210 variant 5 | WO2013140247 SEQ ID NO: 49 | 5272 |
| RSV51 | heavy chain variable, F protein of RSV, MPV, or PVM | 2430 variant 3, 2430 variant 4 | WO2013140247 SEQ ID NO: 59 | 5273 |
| RSV52 | Heavy chain variable, CDR Grafted, F Protein, | | US20140093501 SEQ ID NO: 31 | 5274 |
| RSV53 | Heavy chain, F Protein | AM22 | US8568726 SEQ ID NO: 16 | 5275 |
| RSV54 | Heavy chain, F Protein | RSVF2-5 | US8221759 SEQ ID NO: 1 | 5276 |
| RSV55 | Heavy chain, F Protein | | EP1259547; US8153133 SEQ ID NO: 4 | 5277 |
| RSV56 | Heavy chain, F Protein | MEDI-493/Pavitizumab-N-VL (Brand name Synagis) | EP1259547; US8153133 SEQ ID NO: 2 | 5278 |
| RSV57 | Heavy chain, F Protein | | EP1259547; US8153133 SEQ ID NO: 36 | 5279 |
| RSV58 | Heavy chain, F Protein | clone 18 | EP1259547; US8153133 SEQ ID NO: 37 | 5280 |
| RSV59 | Heavy chain, F Protein | clone 19 | EP1259547; US8153133 SEQ ID NO: 39 | 5281 |
| RSV60 | Heavy chain, F Protein | clone 20 | EP1259547; US8153133 SEQ ID NO: 41 | 5282 |
| RSV61 | Heavy chain, F Protein | clone 21 | EP1259547; US8153133 SEQ ID NO: 43 | 5283 |
| RSV62 | Heavy chain, F Protein | clone 22 | EP1259547; US8153133 SEQ ID NO: 45 | 5284 |
| RSV63 | Heavy chain, F Protein | clone 23 | EP1259547; US8153133 SEQ ID NO: 47 | 5285 |

TABLE 22-continued

Antibodies against Respiratory Syncytial Virus

| Antibody No. | Description | Antibody Name | Reference Information | SEQ ID NO |
|---|---|---|---|---|
| RSV64 | Heavy chain, F Protein | clone 24 | EP1259547; US8153133 SEQ ID NO: 49 | 5286 |
| RSV65 | Heavy chain, F Protein | clone 25 | EP1259547; US8153133 SEQ ID NO: 51 | 5287 |
| RSV66 | Heavy chain, F Protein | clone 26 | EP1259547; US8153133 SEQ ID NO: 53 | 5288 |
| RSV67 | Heavy chain variable region, F Protein | | US20140093501 SEQ ID NO: 17 | 5289 |
| RSV68 | Heavy chain variable region, F Protein | MAb1308F | US20140093501 SEQ ID NO: 18 | 5290 |
| RSV69 | Heavy chain variable region, F Protein | huCOR | US20140093501 SEQ ID NO: 30 | 5291 |
| RSV70 | Heavy chain variable region, F Protein | MAb1129 | US20140093501 SEQ ID NO: 32 | 5292 |
| RSV71 | Heavy chain variable region, F Protein | RSV G8 | US7867497 SEQ ID NO: 2 | 5293 |
| RSV72 | Heavy chain variable region, F Protein | Clone 1 | US20120135006 SEQ ID NO: 18 | 5294 |
| RSV73 | Heavy chain variable region, F Protein | Clone 2 | US20120135006 SEQ ID NO: 20 | 5295 |
| RSV74 | Heavy chain variable region, F Protein | Clone 3 | US20120135006 SEQ ID NO: 22 | 5296 |
| RSV75 | Heavy chain variable region, F Protein | Clone 22 | US20120135006 SEQ ID NO: 24 | 5297 |
| RSV76 | Heavy chain variable region, F Protein | Clone 23 | US20120135006 SEQ ID NO: 26 | 5298 |
| RSV77 | Heavy chain variable region, F Protein | RSV13-9 | WO2009088159 SEQ ID NO: 4 | 5299 |
| RSV78 | HV3 heavy chain variable, F Protein | | US20140093501 SEQ ID NO: 16 | 5300 |
| RSV79 | Constant heavy region, F protein | B4HuVK | EP636182; WO1993020210; SEQ ID NO: 6 | 5301 |
| RSV80 | Constant heavy region, F protein | B13/B14HuVK | EP636182; WO1993020210; SEQ ID NO: 8 | 5302 |
| RSV81 | Heavy chain, F protein | 58c5 | US20140044719 SEQ ID NO: 1 | 5303 |
| RSV82 | Heavy chain, F protein | sc5 | US20140044719 SEQ ID NO: 9 | 5304 |
| RSV83 | Heavy chain, F protein | | US20110027294 SEQ ID NO: 74 | 5305 |
| RSV84 | Heavy chain, F protein | | US20110027294 SEQ ID NO: 75 | 5306 |
| RSV85 | Heavy chain, F protein | | US20110027294 SEQ ID NO: 76 | 5307 |
| RSV86 | Heavy chain, F protein | | US20110027294 SEQ ID NO: 77 | 5308 |
| RSV87 | Heavy chain, F protein | | US20110027294 SEQ ID NO: 78 | 5309 |
| RSV88 | Heavy chain, F protein | | US20110027294 SEQ ID NO: 79 | 5310 |
| RSV89 | Heavy chain, F protein | | US20110027294 SEQ ID NO: 80 | 531,1 |
| RSV90 | Heavy chain, F protein | Gλ-1 | US20050175986 SEQ ID NO: 5 | 5312 |
| RSV91 | Heavy chain, F protein | A construct | US20050175986 SEQ ID NO: 7 | 5313 |
| RSV92 | Heavy chain, F protein | B construct | US200501,75986 SEQ ID NO: 8 | 5314 |
| RSV93 | Heavy chain, F protein | hu19A | US20050019758; WO1998019704 SEQ ID NO: 5 | 5315 |
| RSV94 | Heavy chain, F protein | hu19B | US20050019758; WO1998019704 SEQ ID NO: 6 | 5316 |
| RSV95 | Heavy chain, F protein | hu19C | US20050019758; WO1998019704 SEQ ID NO: 7 | 5317 |
| RSV96 | Heavy chain, F protein | hu19D | US20050019758; WO1998019704 SEQ ID NO: 8 | 5318 |
| RSV97 | Heavy chain, F protein | B4HuVH | EP636182; WO1993020210; SEQ ID NO: 5 | 5319 |
| RSV98 | Heavy chain, F protein | B13/B14HuVK | EP636182; WO1993020210; SEQ ID NO: 7 | 5320 |
| RSV99 | Heavy chain, F protein | RSV19 | EP636182; WO1993020210; SEQ ID NO: 10 | 5321 |
| RSV100 | Heavy chain, F protein | | WO19922004381 | 5322 |
| RSV101 | Heavy chain, F protein | | WO19922004381 | 5323 |
| RSV102 | Heavy chain variable region, F Protein | P1212 | US20140044719 SEQ ID NO: 122 | 5324 |
| RSV103 | Heavy chain variable region, F Protein | P12f4 | US20140044719 SEQ ID NO: 131 | 5325 |
| RSV104 | Heavy chain variable region, F Protein | P11d4 | US20140044719 SEQ ID NO: 137 | 5326 |

TABLE 22-continued

Antibodies against Respiratory Syncytial Virus

| Antibody No. | Description | Antibody Name | Reference Information | SEQ ID NO |
|---|---|---|---|---|
| RSV105 | Heavy chain variable region, F Protein | A1e9 | US20140044719 SEQ ID NO: 144 | 5327 |
| RSV106 | Heavy chain variable region, F Protein | A12a6 | US20140044719 SEQ ID NO: 149 | 5328 |
| RSV107 | Heavy chain variable region, F Protein | A13c4 | US20140044719 SEQ ID NO: 155 | 5329 |
| RSV108 | Heavy chain variable region, F Protein | A17d4 | US20140044719 SEQ ID NO: 161 | 5330 |
| RSV109 | Heavy chain variable region, F Protein | A4B4 | US20140044719 SEQ ID NO: 167 | 5331 |
| RSV110 | Heavy chain variable region, F Protein | A8c7 | US20140044719 SEQ ID NO: 172 | 5332 |
| RSV111 | Heavy chain variable region, F Protein | IX-493L1R | US20140044719 SEQ ID NO: 176 | 5333 |
| RSV112 | Heavy chain variable region, F Protein | M3H9 | US20140044719 SEQ ID NO: 181 | 5334 |
| RSV113 | Heavy chain variable region, F Protein | B21M | US20110027294 SEQ ID NO: 49 | 5335 |
| RSV114 | Heavy chain variable region, F Protein | 101F | US20110027294 SEQ ID NO: 4 | 5336 |
| RSV115 | Heavy chain variable region, F Protein | HNK20 | EP1720908; WO2005079479 SEQ ID NO: 1 | 5337 |
| RSV116 | Heavy chain variable region, F Protein | P1212 | US20140044719 SEQ ID NO: 123 | 5338 |
| RSV117 | Heavy chain variable region, F Protein | P12f4 | US20140044719 SEQ ID NO: 132 | 5339 |
| RSV118 | Heavy chain variable region, F Protein | P11d4 | US20140044719 SEQ ID NO: 138 | 5340 |
| RSV119 | Heavy chain variable region, F Protein | A1e9 | US20140044719 SEQ ID NO: 145 | 5341 |
| RSV120 | Heavy chain variable region, F Protein | A12a6 | US20140044719 SEQ ID NO: 150 | 5342 |
| RSV121 | Heavy chain variable region, F Protein | A13c4 | US20140044719 SEQ ID NO: 156 | 5343 |
| RSV122 | Heavy chain variable region, F Protein | A17d4 | US20140044719 SEQ ID NO: 162 | 5344 |
| RSV123 | Heavy chain variable region, F Protein | A4B4 | US20140044719 SEQ ID NO: 168 | 5345 |
| RSV124 | Heavy chain variable region, F Protein | A8c7 | US20140044719 SEQ ID NO: 173 | 5346 |
| RSV125 | Heavy chain variable region, F Protein | IX-493L1FR | US20140044719 SEQ ID NO: 177 | 5347 |
| RSV126 | Heavy chain variable region, F Protein | H1 H3564P | WO2014159822 SEQ ID NO: 2 | 5348 |
| RSV127 | Heavy chain variable region, F Protein | H1 H3565P | WO2014159822 SEQ ID NO: 18 | 5349 |
| RSV128 | Heavy chain variable region, F Protein | H1 H3566P | WO2014159822 SEQ ID NO: 34 | 5350 |
| RSV129 | Heavy chain variable region, F Protein | H1 H3567P | WO2014159822 SEQ ID NO: 50 | 5351 |
| RSV130 | Heavy chain variable region, F Protein | H1 H3581P | WO2014159822 SEQ ID NO: 66 | 5352 |
| RSV131 | Heavy chain variable region, F Protein | H1 H3583P | WO2014159822 SEQ ID NO: 82 | 5353 |
| RSV132 | Heavy chain variable region, F Protein | H1 H3589P | WO2014159822 SEQ ID NO: 98 | 5354 |
| RSV133 | Heavy chain variable region, F Protein | H1 H3591 P | WO2014159822 SEQ ID NO: 114 | 5355 |
| RSV134 | Heavy chain variable region, F Protein | H1 H3592P | WO2014159822 SEQ ID NO: 130 | 5356 |
| RSV135 | Heavy chain variable region, F Protein | H1 H3597P | WO2014159822 SEQ ID NO: 146 | 5357 |
| RSV136 | Heavy chain variable region, F Protein | H1 H3598P | WO2014159822 SEQ ID NO: 162 | 5358 |
| RSV137 | Heavy chain variable region, F Protein | H1 H3603P | WO2014159822 SEQ ID NO: 178 | 5359 |
| RSV138 | Heavy chain variable region, F Protein | H1 H3604P | WO2014159822 SEQ ID NO: 194 | 5360 |
| RSV139 | Heavy chain variable region, F Protein | H1 H3605P | WO2014159822 SEQ ID NO: 210 | 5361 |
| RSV140 | Heavy chain variable region, F Protein | H1 H3607P | WO2014159822 SEQ ID NO: 226 | 5362 |
| RSV141 | Heavy chain variable region, F Protein | H1 H3608P2 | WO2014159822 SEQ ID NO: 242 | 5363 |

TABLE 22-continued

Antibodies against Respiratory Syncytial Virus

| Antibody No. | Description | Antibody Name | Reference Information | SEQ ID NO |
|---|---|---|---|---|
| RSV142 | Heavy chain variable region, F Protein | H1 H3592P2 | WO2014159822 SEQ ID NO: 258 | 5364 |
| RSV143 | Heavy chain variable region, F Protein | H1 H3592P3 | WO2014159822 SEQ ID NO: 274 | 5365 |
| RSV144 | Heavy chain variable region, F Protein | H1 M3621 N | WO2014159822 SEQ ID NO: 290 | 5366 |
| RSV145 | Heavy chain variable region, F Protein | H1 M3622N | WO2014159822 SEQ ID NO: 306 | 5367 |
| RSV146 | Heavy chain variable region, F Protein | H1 M2634N | WO2014159822 SEQ ID NO: 322 | 5368 |
| RSV147 | Heavy chain variable region, F Protein | H1 M3627N | WO2014159822 SEQ ID NO: 338 | 5369 |
| RSV148 | Heavy chain variable region, F Protein | Clone No. 735 | US20120009623 SEQ ID NO: 1 | 5370 |
| RSV149 | Heavy chain variable region, F Protein | Clone No. 736 | US20120009623 SEQ ID NO: 2 | 5371 |
| RSV150 | Heavy chain variable region, F Protein | Clone No. 744 | US20120009623 SEQ ID NO: 3 | 5372 |
| RSV151 | Heavy chain variable region, F Protein | Clone No. 793 | US20120009623 SEQ ID NO: 4 | 5373 |
| RSV152 | Heavy chain variable region, F Protein | Clone No. 795 | US21120009623 SEQ ID NO: 5 | 5374 |
| RSV153 | Heavy chain variable region, F Protein | Clone No. 796 | US20120009623 SEQ ID NO: 6 | 5375 |
| RSV154 | Heavy chain variable region, F Protein | Clone No. 799 | US20120009623 SEQ ID NO: 7 | 5376 |
| RSV155 | Heavy chain variable region, F Protein | Clone No. 800 | US20120009623 SEQ ID NO: 8 | 5377 |
| RSV156 | Heavy chain variable region, F Protein | Clone No. 801 | US20120009623 SEQ ID NO: 9 | 5378 |
| RSV157 | Heavy chain variable region, F Protein | Clone No. 804 | US20120009623 SEQ ID NO: 10 | 5379 |
| RSV158 | Heavy chain variable region, F Protein | Clone No. 810 | US20120009623 SEQ ID NO: 11 | 5380 |
| RSV159 | Heavy chain variable region, F Protein | Clone No. 811 | US20120009623 SEQ ID NO: 12 | 5381 |
| RSV160 | Heavy chain variable region, F Protein | Clone No. 812 | US20120009623 SEQ ID NO: 13 | 5382 |
| RSV161 | Heavy chain variable region, F Protein | Clone No. 814 | US20120009623 SEQ ID NO: 14 | 5383 |
| RSV162 | Heavy chain variable region, F Protein | Clone No. 816 | US20120009623 SEQ ID NO: 15 | 5384 |
| RSV163 | Heavy chain variable region, F Protein | Clone No. 817 | US20120009623 SEQ ID NO: 16 | 5385 |
| RSV164 | Heavy chain variable region, F Protein | Clone No. 818 | US20120009613 SEQ ID NO: 17 | 5386 |
| RSV165 | Heavy chain variable region, F Protein | Clone No. 819 | US20120009 23 SEQ ID NO: 18 | 5387 |
| RSV166 | Heavy chain variable region, F Protein | Clone No. 824 | US20120009623 SEQ ID NO: 19 | 5388 |
| RSV167 | Heavy chain variable region, F Protein | Clone No. 825 | US20120009623 SEQ ID NO: 20 | 5389 |
| RSV168 | Heavy chain variable region, F Protein | Clone No. 827 | US20120009623 SEQ ID NO: 21 | 5390 |
| RSV169 | Heavy chain variable region, F Protein | Clone No. 829 | US20120009623 SEQ ID NO: 22 | 5391 |
| RSV170 | Heavy chain variable region, F Protein | Clone No. 830 | US20120009623 SEQ ID NO: 23 | 5392 |
| RSV171 | Heavy chain variable region, F Protein | Clone No. 831 | US20120009623 SEQ ID NO: 24 | 5393 |
| RSV172 | Heavy chain variable region, F Protein | Clone No. 835 | US20120009623 SEQ ID NO: 25 | 5394 |
| RSV173 | Heavy chain variable region, F Protein | Clone No. 838 | US20120009623 SEQ ID NO: 26 | 5395 |
| RSV174 | Heavy chain variable region, F Protein | Clone No. 841 | US20120009623 SEQ ID NO: 27 | 5396 |
| RSV175 | Heavy chain variable region, F Protein | Clone No. 853 | US20120009623 SEQ ID NO: 28 | 5397 |
| RSV176 | Heavy chain variable region, F Protein | Clone No. 855 | US20120009623 SEQ ID NO: 29 | 5398 |
| RSV177 | Heavy chain variable region, F Protein | Clone No. 856 | US20120009623 SEQ ID NO: 30 | 5399 |
| RSV178 | Heavy chain variable region, F Protein | Clone No. 857 | US20120009623 SEQ ID NO: 31 | 5400 |

TABLE 22-continued

Antibodies against Respiratory Syncytial Virus

| Antibody No. | Description | Antibody Name | Reference Information | SEQ ID NO |
|---|---|---|---|---|
| RSV179 | Heavy chain variable region, F Protein | Clone No. 858 | US20120009623 SEQ ID NO: 32 | 5401 |
| RSV180 | Heavy chain variable region, F Protein | Clone No. 859 | US20120009623 SEQ ID NO: 33 | 5402 |
| RSV181 | Heavy chain variable region, F Protein | Clone No. 861 | US20120009623 SEQ ID NO: 34 | 5403 |
| RSV182 | Heavy chain variable region, F Protein | Clone No. 863 | US20120009623 SEQ ID NO: 35 | 5404 |
| RSV183 | Heavy chain variable region, F Protein | Clone No. 868 | US20120009623 SEQ ID NO: 36 | 5405 |
| RSV184 | Heavy chain variable region, F Protein | Clone No. 870 | US20120009623 SEQ ID NO: 37 | 5406 |
| RSV185 | Heavy chain variable region, F Protein | Clone No. 871 | US20120009623 SEQ ID NO: 38 | 5407 |
| RSV186 | Heavy chain variable region, F Protein | Clone No. 880 | US20120009623 SEQ ID NO: 39 | 5408 |
| RSV187 | Heavy chain variable region, F Protein | Clone No. 881 | US20120009623 SEQ ID NO: 40 | 5409 |
| RSV188 | Heavy chain variable region, F Protein | Clone No. 884 | US20120009623 SEQ ID NO: 41 | 5410 |
| RSV189 | Heavy chain variable region, F Protein | Clone No. 886 | US20120009623 SEQ ID NO: 42 | 5411 |
| RSV190 | Heavy chain variable region, F Protein | Clone No. 888 | US20120009623 SEQ ID NO: 43 | 5412 |
| RSV191 | Heavy chain variable region, F Protein | Clone No. 894 | US20120009623 SEQ ID NO: 44 | 5413 |
| RSV192 | Heavy chain variable region, F Protein | Gλ-1 | US20050175986 SEQ ID NO: 4 | 5414 |
| RSV193 | Super humanized heavy chain based on HNK20, F protein | SHVh1 | EP1720908; WO2005079479 SEQ ID NO: 3 | 5415 |
| RSV194 | Super humanized heavy chain based on HNK20, F protein | SHVh2 | EP1720908; WO2005079479 SEQ ID NO: 4 | 5416 |
| RSV195 | Super humanized heavy chain based on HNK20, F protein | SHVh3 | EP1720908; WO2005079479 SEQ ID NO: 5 | 5417 |
| RSV196 | Super humanized heavy chain based on HNK20, F protein | SHVh4 | EP1720908; WO2005079479 SEQ ID NO: 6 | 5418 |
| RSV197 | Super humanized heavy chain based on HNK20, F protein | SHVh5 | EP1720908; WO2005079479 SEQ ID NO: 7 | 5419 |
| RSV198 | Super humanized heavy chain based on HNK20, F protein | SHVh6 | EP1720908; WO2005079479 SEQ ID NO: 8 | 5420 |
| RSV199 | Super humanized heavy chain based on HNK20, F protein | SHVh7 | EP1720908; WO2005079479 SEQ ID NO: 9 | 5421 |
| RSV200 | Heavy chain variable region, F Protein | B4 | EP636182; WO1993020210; SEQ ID NO: 3 | 5422 |
| RSV201 | Heavy chain variable region, F Protein | B13/14 | EP636182; WO1993020210; SEQ ID NO: 4 | 5423 |
| RSV202 | Heavy chain variable region, F Protein | RF-1 | EP854730; WO1996040252; FIG. 7B | 5424 |
| RSV203 | Heavy chain variable region, F Protein | RF-2 | EP854730; WO1996040252; FIG. 8B | 5425 |
| RSV204 | Heavy chain, G Protein | 1F12 | US8273354 SEQ ID NO: 28 | 5426 |
| RSV205 | Heavy chain, G Protein | 3G12 | US8273354 SEQ ID NO: 29 | 5427 |
| RSV206 | Heavy chain, G Protein | 1A5 | US8273354 SEQ ID NO: 30 | 5428 |
| RSV207 | Heavy chain, G Protein | 3D3 | US8273354 SEQ ID NO: 31 | 5429 |
| RSV208 | Heavy chain, G Protein | 1G1 | US8273354 SEQ ID NO: 32 | 5430 |
| RSV209 | Heavy chain, G Protein | 2B11 | US8273354 SEQ ID NO: 33 | 5431 |
| RSV210 | Heavy chain, G Protein | 5D8 | US8273354 SEQ ID NO: 34 | 5432 |
| RSV211 | Heavy chain, G Protein | 2D10 | US8273354 SEQ ID NO: 35 | 5433 |
| RSV212 | Heavy chain, G Protein | 3F9 | US8273354 SEQ ID NO: 36 | 5434 |
| RSV213 | Heavy chain, G Protein | 1D4 | US8273354 SEQ ID NO: 37 | 5435 |
| RSV214 | Heavy chain, G Protein | 1G8 | US8273354 SEQ ID NO: 38 | 5436 |
| RSV215 | Heavy chain, G Protein | 6A12 | US8273354 SEQ ID NO: 39 | 5437 |
| RSV216 | Heavy chain, G Protein | 10C6 | US8273354 SEQ ID NO: 40 | 5438 |
| RSV217 | Heavy chain, G Protein | Hu 131-2G | US8273354 SEQ ID NO: 41 | 5439 |
| RSV218 | Heavy chain, G Protein | AT46 | US20150004155 SEQ ID NO: 109 | 5440 |
| RSV219 | Heavy chain, G Protein | AT32 | US20150004155 SEQ ID NO: 110 | 5441 |
| RSV220 | Heavy chain, G Protein | AT33 | US20150004155 SEQ ID NO: 111 | 5442 |
| RSV221 | Heavy chain, G Protein | AT34 | US20150004155 SEQ ID NO: 112 | 5443 |
| RSV222 | Heavy chain, G Protein | AT735 | US20150004155 SEQ ID NO: 113 | 5444 |

TABLE 22-continued

Antibodies against Respiratory Syncytial Virus

| Antibody No. | Description | Antibody Name | Reference Information | SEQ ID NO |
|---|---|---|---|---|
| RSV223 | Heavy chain, G Protein | AT36 | US20150004155 SEQ ID NO: 114 | 5445 |
| RSV224 | Heavy chain, G Protein | AT737 | US20150004155 SEQ ID NO: 115 | 5446 |
| RSV225 | Heavy chain, G Protein | AT39 | US20150004155 SEQ ID NO: 116 | 5447 |
| RSV226 | Heavy chain, G Protein | AT40 | US20150004155 SEQ ID NO: 117 | 5448 |
| RSV227 | Heavy chain, G Protein | AT42 | US2010004155 SEQ ID NO: 118 | 5449 |
| RSV228 | Heavy chain, G Protein | AT43 | US20150004155 SEQ ID NO: 119 | 5450 |
| RSV229 | Heavy chain, G Protein | AT44 | US20150004155 SEQ ID NO: 120 | 5451 |
| RSV230 | Heavy chain, G Protein | AT45 | US20150004155 SEQ ID NO: 121 | 5452 |
| RSV231 | Heavy chain, G Protein | AT47 | US20150004155 SEQ ID NO: 122 | 5453 |
| RSV232 | Heavy chain, G Protein | AT49 | US20150004155 SEQ ID NO: 123 | 5454 |
| RSV233 | Heavy chain, G Protein | AT50 | US20150004155 SEQ ID NO: 124 | 5455 |
| RSV234 | Heavy chain, G Protein | AT51 | US20150004155 SEQ ID NO: 125 | 5456 |
| RSV235 | Heavy chain variable region, G Protein | CB058.1 | WO2014170257 SEQ ID NO: 37 | 5457 |
| RSV236 | Heavy chain variable region, G Protein | CB048.3 | WO2014170257 SEQ ID NO: 39 | 5458 |
| RSV237 | Heavy chain variable region, G Protein | CB010.7 | WO2014170257 SEQ ID NO: 41 | 5459 |
| RSV238 | Heavy chain variable region, G Protein | CB003.1 | WO2014170257 SEQ ID NO: 43 | 5460 |
| RSV239 | Heavy chain variable region, G Protein | CB028.2 | WO2014170257 SEQ ID NO: 45 | 5461 |
| RSV240 | Heavy chain variable region, G Protein | CB002.1 | WO2014170257 SEQ ID NO: 47 | 5462 |
| RSV241 | Heavy chain variable region, G Protein | CB017.3L | WO2014170258 SEQ ID NO: 73 | 5463 |
| RSV242 | Heavy chain variable region, G Protein | CB017.5L | WO2014170258 SEQ ID NO: 75 | 5464 |
| RSV243 | Heavy chain variable region, G Protein | CB028.1 | WO2014170258 SEQ ID NO: 77 | 5465 |
| RSV244 | Heavy chain variable region, G Protein | CB030.1 | WO2014170258 SEQ ID NO: 79 | 5466 |
| RSV245 | Heavy chain variable region, G Protein | CB047.1 | WO2014170258 SEQ ID NO: 81 | 5467 |
| RSV246 | Heavy chain variable region, G Protein | CB04712 | WO2014170258 SEQ ID NO: 83 | 5468 |
| RSV247 | Heavy chain variable region, G Protein | CB065.1 | WO2014170258 SEQ ID NO: 85 | 5469 |
| RSV248 | Heavy chain variable region, G Protein | CB071.1L | WO2014170258 SEQ ID NO: 87 | 5470 |
| RSV249 | Heavy chain variable region, G Protein | CB072.1L | WO2014170258 SEQ ID NO: 89 | 5471 |
| RSV250 | Heavy chain variable region, G Protein | CB073.1L | WO2014170258 SEQ ID NO: 91 | 5472 |
| RSV251 | Heavy chain variable region, G Protein | CB076.2L | WO2014170258 SEQ ID NO: 93 | 5473 |
| RSV252 | Heavy chain variable region, G Protein | CB079.1 | WO2014170258 SEQ ID NO: 95 | 5474 |
| RSV253 | Heavy chain | AM14 | US20140377279 SEQ ID NO: 78 | 5475 |
| RSV254 | Heavy chain | AM16 | US20140377279 SEQ ID NO: 85 | 5476 |
| RSV255 | Heavy chain | AM23 | US20140377279 SEQ ID NO: 92 | 5477 |
| RSV256 | Heavy chain | D25 | US20140377279 SEQ ID NO: 7 | 5478 |
| RSV257 | Heavy chain | AFFF | US7635568 SEQ ID NO: 210 | 5479 |
| RSV258 | Heavy chain | P12f2 | US7635568 SEQ ID NO: 212 | 5480 |
| RSV259 | Heavy chain | P12f4 | US7635568 SEQ ID NO: 214 | 5481 |
| RSV260 | Heavy chain | P11d4 | US7635568 SEQ ID NO: 216 | 5482 |
| RSV261 | Heavy chain | Ale9 | US7635568 SEQ ID NO: 218 | 5483 |
| RSV262 | Heavy chain | A12a6 | US7635568 SEQ ID NO: 220 | 5484 |
| RSV263 | Heavy chain | A13c4 | US7635568 SEQ ID NO: 222 | 5485 |
| RSV264 | Heavy chain | A17d4 | US7635568 SEQ ID NO: 224 | 5486 |

TABLE 22-continued

Antibodies against Respiratory Syncytial Virus

| Antibody No. | Description | Antibody Name | Reference Information | SEQ ID NO |
|---|---|---|---|---|
| RSV265 | Heavy chain | A4B4 | US7635568 SEQ ID NO: 226 | 5487 |
| RSV266 | Heavy chain | A8c7 | US7635568 SEQ ID NO: 228 | 5488 |
| RSV267 | Heavy chain | 1X-493L1FR | US7635568 SEQ ID NO: 230 | 5489 |
| RSV268 | Heavy chain | H3-3F4 | US7635568 SEQ ID NO: 232 | 5490 |
| RSV269 | Heavy chain | M3H9 | US7635568 SEQ ID NO: 234 | 5491 |
| RSV270 | Heavy chain | Y10H6 | US7635568 SEQ ID NO: 236 | 5492 |
| RSV271 | Heavy chain | DG | US7635568 SEQ ID NO: 238 | 5493 |
| RSV272 | Heavy chain | AFFF(1) | US7635568 SEQ ID NO: 240 | 5494 |
| RSV273 | Heavy chain | 6H8 | US7635568 SEQ ID NO: 242 | 5495 |
| RSV274 | Heavy chain | L1-7E5 | US7635568 SEQ ID NO: 244 | 5496 |
| RSV275 | Heavy chain | L2-15B10 | US7635568 SEQ ID NO: 246 | 5497 |
| RSV276 | Heavy chain | A13a11 | US7635568 SEQ ID NO: 248 | 5498 |
| RSV277 | Heavy chain | A1h5 | US7635568 SEQ ID NO: 250 | 5499 |
| RSV278 | Heavy chain | A4B4(1) | US7635568 SEQ ID NO: 252 | 5500 |
| RSV279 | Heavy chain | A4B4L1FR-S28R (MEDI-524, Motavizumab, Numax) | US7635568 SEQ ID NO: 254 | 5501 |
| RSV280 | Heavy chain | A4B4-F52S | US7635568 SEQ ID NO: 256 | 5502 |
| RSV281 | Heavy chain | | US7364737 SEQ ID NO: 1 | 5503 |
| RSV282 | Heavy chain | | US7364737 SEQ ID NO: 2 | 5504 |
| RSV283 | Heavy chain variable region | J variant | WO2015108967 SEQ ID NO: 12 | 5505 |
| RSV284 | Heavy chainvariable region | L variant | WO2015108967 SEQ ID NO: 13 | 5506 |
| RSV285 | Heavy chain variable region | LA variant | WO2015108967 SEQ ID NO: 14 | 5507 |
| RSV286 | Heavy chain variable region | 1G7 | WO2015108967 SEQ ID NO: 15 | 5508 |
| RSV287 | Heavy chain variable region | 1F5 | WO2015108967 SEQ ID NO: 16 | 5509 |
| RSV288 | Heavy chain variable region | 2D10 | WO2015108967 SEQ ID NO: 17 | 5510 |
| RSV289 | Heavy chain variable region | 1G7-GLM | WO2015108967 SEQ ID NO: 18 | 5511 |
| RSV290 | Heavy chain variable region | B12-1 | WO2015108967 SEQ ID NO: 19 | 5512 |
| RSV291 | Heavy chain variable region | E3-5 | WO2015108967 SEQ ID NO: 20 | 5513 |
| RSV292 | Heavy chain variable region | E9-2 | WO2015108967 SEQ ID NO: 21 | 5514 |
| RSV293 | Heavy chain variable region | 1X-493L1FR | US7635568 SEQ ID NO: 7 | 5515 |
| RSV294 | Heavy chain variable region | AFFF, AFFF(1) | US7635568 SEQ ID NO: 9 | 5516 |
| RSV295 | Heavy chain variable region | P12f2 | US7635568 SEQ ID NO: 17 | 5517 |
| RSV296 | Heavy chain variable region | P12f4 | US7635568 SEQ ID NO: 24 | 5518 |
| RSV297 | Heavy chain variable region | P11d4 | US7635568 SEQ ID NO: 28 | 5519 |
| RSV298 | Heavy chain variable region | A1e9, A1h5 | US7635568 SEQ ID NO: 33 | 5520 |
| RSV299 | Heavy chain variable region | A12a6 | US7635568 SEQ ID NO: 36 | 5521 |
| RSV300 | Heavy chain variable region | A13c4 | US7635568 SEQ ID NO: 40 | 5522 |
| RSV301 | Heavy chain variable region | A17d4 | US7635568 SEQ ID NO: 44 | 5523 |
| RSV302 | Heavy chain variable region | A4B4, A4B4(1), A4B4L1FR-S28R (MEDI-524, Motavizumab, Numax), A4B4-F52S | US7635568 SEQ ID NO: 48 | 5524 |
| RSV303 | Heavy chain variable region | A8c7 | US7635568 SEQ ID NO: 51 | 5525 |
| RSV304 | Heavy chain variable region | H3-3F4, M3H9, Y10H6 | US7635568 SEQ ID NO: 55 | 5526 |
| RSV305 | Heavy chain variable region | DG, 6H8, L1-7E5, L2-15B10 | US7635568 SEQ ID NO: 78 | 5527 |
| RSV306 | Heavy chain variable region | A13a11 | US7635568 SEQ ID NO: 67 | 5528 |
| RSV307 | Heavy chain variable region | | US7364742 SEQ ID NO: 7 | 5529 |
| RSV308 | Heavy chain variable region | | US7364742 SEQ ID NO: 8 | 5530 |
| RSV309 | Heavy chain variable region | D2E7 | EP1807111; WO2006041970 SEQ ID NO: 2 | 5531 |
| RSV310 | Heavy chain variable region | 2SD4 | EP1807111; WO2006041970 SEQ ID NO: 10 | 5532 |
| RSV311 | Heavy chain, human metapneumovirus fusion protein with neutralizing antibody identifies a pneumovirus antigenic site, | | Wen, X,, "Structure of the human metapneumovirus fusion protein with neutralizing antibody identifies a pneumovirus antigenic site", | 5533 |

TABLE 22-continued

Antibodies against Respiratory Syncytial Virus

| Antibody No. | Description | Antibody Name | Reference Information | SEQ ID NO |
|---|---|---|---|---|
| RSV312 | Heavy chain variable, M2 1 antigen | 8A4/G9-IgG | Nat. Struct. Mol. Biol. 19 (4), 461-463 (2012), NCBI Accession # 4DAG_H(220 aa) US20140348858 SEQ ID NO: 3 | 5534 |
| RSV313 | Heavy chain, Pre fusion RSV F protein | HMB2435 | WO2015010792 SEQ ID NO: 13 | 5535 |
| RSV314 | Heavy chain, Pre fusion RSV F protein | HMB2437 | WO2015010792 SEQ ID NO: 29 | 5536 |
| RSV315 | Heavy chain, Pre fusion RSV F protein | HMB2416 | WO2015010792 SEQ ID NO: 45 | 5537 |
| RSV316 | Heavy chain, Pre fusion RSV F protein, | HMB2437 | WO2015010792 SEQ ID NO: 85 | 5538 |
| RSV317 | Heavy chain, Pre fusion RSV F protein | CR9501 | WO2014202570 SEQ ID NO: 53 | 5539 |
| RSV318 | Heavy chain, Pre fusion RSV F protein | CR9502 | WO2014202570 SEQ ID NO: 57 | 5540 |
| RSV319 | Heavy chain 1, Pre fusion RSV F protein | HMB2432 | WO2015010792 SEQ ID NO: 61 | 5541 |
| RSV320 | Heavy chain 2, Pre fusion RSV F protein | HMB2432 | WO2015010792 SEQ ID NO: 65 | 5542 |
| RSV321 | Heavy chain FR LG, Pre fusion RSV F protein | HMB2435 | WO2015010792 SEQ ID NO: 75 | 5543 |
| RSV322 | light chain, F and G Proteins | clone 735 | US20110189171; US7879329 SEQ ID NO: 89 | 5544 |
| RSV323 | light chain, F and G Proteins | clone 736 | US20110189171; US7879329 SEQ ID NO: 90 | 5545 |
| RSV324 | light chain, F and G Proteins | clone 744 | US20110189171; US7879329 SEQ ID NO: 91 | 5546 |
| RSV325 | light chain, F and G Proteins | clone 793 | US20110189171; US7879329 SEQ ID NO: 92 | 5547 |
| RSV326 | light chain, F and G Proteins | clone 795 | US20110189171; US7879329 SEQ ID NO: 93 | 5548 |
| RSV327 | light chain, F and G Proteins | clone 796 | US20110189171; US7879329 SEQ ID NO: 94 | 5549 |
| RSV328 | light chain, F and G Proteins | clone 799 | US20110189171; US7879329 SEQ ID NO: 95 | 5550 |
| RSV329 | light chain, F and G Proteins | clone 800 | US20110189171; US7879329 SEQ ID NO: 96 | 5551 |
| RSV330 | light chain, F and G Proteins | clone 801 | US20110189171; US7879329 SEQ ID NO: 97 | 5552 |
| RSV331 | light chain, F and G Proteins | clone 804 | US20110189171; US7879329 SEQ ID NO: 98 | 5553 |
| RSV332 | light chain, F and G Proteins | clone 810 | US20110189171; US7879329 SEQ ID NO: 99 | 5554 |
| RSV333 | light chain, F and G Proteins | clone 811 | US20110189171; US7879329 SEQ ID NO: 100 | 5555 |
| RSV334 | light chain, F and G Proteins | clone 812 | US20110189171; US7879329 SEQ ID NO: 101 | 5556 |
| RSV335 | light chain, F and G Proteins | clone 814 | US20110189171; US7879329 SEQ ID NO: 102 | 5557 |
| RSV336 | light chain, F and G Proteins | clone 816 | US20110189171; US7879329 SEQ ID NO: 103 | 5558 |
| RSV337 | light chain, F and G Proteins | clone 817 | US20110189171; US7879329 SEQ ID NO: 104 | 5559 |
| RSV338 | light chain, F and G Proteins | clone 818 | US20110189171; US7879329 SEQ ID NO: 105 | 5560 |
| RSV339 | light chain, F and G Proteins | clone 819 | US20110189171; US7879329 SEQ ID NO: 106 | 5561 |
| RSV340 | light chain, F and G Proteins | clone 824 | US20110189171; US7879329 SEQ ID NO: 107 | 5562 |
| RSV341 | light chain, F and G Proteins | clone 825 | US20110189171; US7879329 SEQ ID NO: 108 | 5563 |
| RSV342 | light chain, F and G Proteins | clone 827 | US20110189171; US7879329 SEQ ID NO: 109 | 5564 |
| RSV343 | light chain, F and G Proteins | clone 829 | US20110189171; US7879329 SEQ ID NO: 110 | 5565 |
| RSV344 | light chain, F and G Proteins | clone 830 | US20110189171; US7879329 SEQ ID NO: 111 | 5566 |
| RSV345 | light chain, F and G Proteins | clone 831 | US20110189171; US7879329 SEQ ID NO: 112 | 5567 |
| RSV346 | light chain, F and G Proteins | clone 835 | US20110189171; US7879329 SEQ ID NO, 113 | 5568 |
| RSV347 | light chain, F and G Proteins | clone 838 | US20110189171; US7879329 SEQ ID NO: 114 | 5569 |

TABLE 22-continued

Antibodies against Respiratory Syncytial Virus

| Antibody No. | Description | Antibody Name | Reference Information | SEQ ID NO |
|---|---|---|---|---|
| RSV348 | light chain, F and G Proteins | clone 841 | US20110189171; US7879329 SEQ ID NO: 115 | 5570 |
| RSV349 | light chain, F and G Proteins | clone 853 | US20110189171; US7879329 SEQ ID NO: 116 | 5571 |
| RSV350 | light chain, F and G Proteins | clone 855 | US20110189171; US7879329 SEQ ID NO: 117 | 5572 |
| RSV351 | light chain, F and G Proteins | clone 856 | US20110189171; US7879329 SEQ ID NO: 118 | 5573 |
| RSV352 | light chain, F and G Proteins | clone 857 | US20110189171; US7879329 SEQ ID NO: 119 | 5574 |
| RSV353 | light chain, F and G Proteins | clone 858 | US20110189171; US7879329 SEQ ID NO: 120 | 5575 |
| RSV354 | light chain, F and G Proteins | clone 859 | US20110189171; US7879329 SEQ ID NO: 121 | 5576 |
| RSV355 | light chain, F and G Proteins | clone 861 | US20110189171; US7879329 SEQ ID NO: 122 | 5577 |
| RSV356 | light chain, F and G Proteins | clone 863 | US20110189171; US7879329 SEQ ID NO: 123 | 5578 |
| RSV357 | light chain, F and G Proteins | clone 868 | US20110189171; US7879329 SEQ ID NO: 124 | 5579 |
| RSV358 | light chain, F and G Proteins | clone 870 | US20110189171; US7879329 SEQ ID NO: 125 | 5580 |
| RSV359 | light chain, F and G Proteins | clone 871 | US20110189171; US7879329 SEQ ID NO: 126 | 5581 |
| RSV360 | light chain, F and G Proteins | clone 880 | US20110189171; US7879329 SEQ ID NO: 127 | 5582 |
| RSV361 | light chain, F and G Proteins | clone 881 | US20110189171; US7879329 SEQ ID NO: 128 | 5383 |
| RSV62 | light chain, F and G Proteins | clone 884 | US20110189171; US7879329 SEQ ID NO: 129 | 5584 |
| RSV363 | light chain, F and G Proteins | clone 886 | US20110189171; US7879329 SEQ ID NO: 130 | 5585 |
| RSV364 | light chain, F and G Proteins | clone 888 | US20110189171; US7879329 SEQ ID NO: 131 | 5586 |
| RSV365 | light chain, F and G Proteins | clone 894 | US20110189171; US7879329 SEQ ID NO: 132 | 5587 |
| RSV366 | Light chain variable, F protein of RSV, MPV, or PVM | 3210 variant 1, 3210 variant 2, 3210 variant 5 | WO2013140247 SEQ ID NO: 14 | 5588 |
| RSV367 | Light chain variable, F protein of RSV, MPV, or PVM | 2430 variant 1, 2430 variant 2, 2430 variant 4 | WO2013140247 SEQ ID NO: 30 | 5589 |
| RSV368 | Light chain variable, F protein of RSV, MPV, or PVM | 3210 variant 3 | WO2013140247 SEQ ID NO: 37 | 5590 |
| RSV369 | Light chain variable, F protein of RSV, MPV, or PVM | 3210 variant 4, 3210 variant 6 | WO20113140247 SEQ ID NO: 50 | 5591 |
| RSV370 | Light chain variable, F protein of RSV, MPV, or PVM | 2430 variant 3, 2430 variant 5 | WO2013140247 SEQ ID NO: 60 | 5592 |
| RSV371 | Light chain, F Protein | clone 19 | EP1259547; US8153133 SEQ ID NO: 40 | 5593 |
| RSV372 | Light chain variable region, CDR Grafted, F Protein | | US20140093501 SEQ ID NO: 20 | 5594 |
| RSV373 | Light chain variable region, CDR Grafted, F Protein | | US20140093501 SEQ ID NO: 34 | 5595 |
| RSV374 | Light chain, F Protein | AM22 | US8568726 SEQ ID NO: 32 | 5596 |
| RSV375 | Light chain, F Protein | RSVF2-5 | US8221759 SEQ ID NO: 9 | 5597 |
| RSV376 | Light chain, F Protein | | EP1259547; US8153133 SEQ ID NO: 3 | 5598 |
| RSV377 | Light chain, F Protein | MTDI-493/Pavilizumab-N-VL (Brand name Synagis) | EP1259547; US8153133 SEQ ID NO: 1 | 5599 |
| RSV378 | Light chain, F Protein | | EP1259547; US8153133 SEQ ID NO: 35 | 5600 |
| RSV379 | Light chain, F Protein | clone 18 | EP1259547; US8153133 SEQ ID NO: 38 | 5601 |
| RSV380 | Light chain, F Protein | clone 20 | ER1259547; US8153133 SEQ ID NO: 42 | 5602 |
| RSV381 | Light chain, F Protein | clone 21 | EP1259547; US8153133 SEQ ID NO: 44 | 5603 |
| RSV382 | Light chain, F Protein | clone 22 | ER1259547; US8153133 SEQ ID NO: 46 | 5604 |
| RSV383 | Light chain, F Protein | clone 23 | EP1259547; US8153133 SEQ ID NO: 48 | 5605 |

TABLE 22-continued

Antibodies against Respiratory Syncytial Virus

| Antibody No. | Description | Antibody Name | Reference Information | SEQ ID NO |
|---|---|---|---|---|
| RSV384 | Light chain, F Protein | clone 24 | ER1259547; US8153133 SEQ ID NO: 50 | 5606 |
| RSV385 | Light chain, F Protein | clone 25 | EP1259547; US8153133 SEQ ID NO: 52 | 5607 |
| RSV386 | Light chain, F Protein | clone 26 | ER1259547; US8153133 SEQ ID NO: 54 | 5608 |
| RSV387 | Light chain variable region, F Protein | huK102 | US20140093501 SEQ ID NO: 19 | 5609 |
| RSV388 | Light chain variable region, F Protein | huK102 | US20140093501 SEQ ID NO: 33 | 5610 |
| RSV389 | Light chain variable region, F Protein | RSV G8 | US7867497 SEQ ID NO: 4 | 5611 |
| RSV390 | Light chain variable region, F Protein | Clone 1 | US20120135006 SEQ ID NO: 17 | 5612 |
| RSV391 | Light chain variable region, F Protein | Clone 2 | US20120135006 SEQ ID NO: 19 | 5613 |
| RSV392 | Light chain variable region, F Protein | Clone 3 | US20120135006 SEQ ID NO: 21 | 5614 |
| RSV393 | Light chain variable region, F Protein | Clone 22 | US20120135006 SEQ ID NO: 23 | 5615 |
| RSV394 | Light chain variable region, F Protein | Clone 23 | US20120135006 SEQ ID NO: 25 | 5616 |
| RSV395 | Light chain variable region, F Protein | RSV13-9 | WO2009088159 SEQ ID NO: 2 | 5617 |
| RSV396 | Light chain variable region, F Protein | MAb1308F | US20140093501 SEQ ID NO: 21 | 5618 |
| RSV397 | Light chain, F Protein | 58c5 | US20140044719 SEQ ID NO: 5 | 5619 |
| RSV398 | Light chain, F Protein | sc5 | US20140044719 SEQ ID NO: 13 | 5620 |
| RSV399 | Light chain, F Protein | Clone No. 735 | US20120009623 SEQ ID NO: 89 | 5621 |
| RSV400 | Light chain, F Protein | Clone No. 736 | US20120009623 SEQ ID NO: 90 | 5622 |
| RSV401 | Light chain, F Protein | Clone No. 744 | US20120009623 SEQ ID NO: 91 | 5623 |
| RSV402 | Light chain, F Protein | Clone No. 793 | US20120009623 SEQ ID NO: 92 | 5624 |
| RSV403 | Light chain, F Protein | Clone No. 795 | US20120009623 SEQ ID NO: 93 | 5625 |
| RSV404 | Light chain, F Protein | Clone No. 796 | US20120009623 SEQ ID NO: 94 | 5626 |
| RSV405 | Light chain, F Protein | Clone No. 799 | US20120009623 SEQ ID NO: 95 | 5627 |
| RSV406 | Light chain, F Protein | Clone No. 800 | US20120009623 SEQ ID NO: 96 | 5628 |
| RSV407 | Light chain, F Protein | Clone No. 801 | US20120009623 SEQ ID NO: 97 | 5629 |
| RSV408 | Light chain, F Protein | Clone No. 804 | US20120009623 SEQ ID NO: 98 | 5630 |
| RSV409 | Light chain, F Protein | Clone No. 810 | US2012000923 SEQ ID NO: 99 | 5631 |
| RSV410 | Light chain, F Protein | Clone No. 811 | US20120009623 SEQ ID NO: 100 | 5632 |
| RSV411 | Light chain, F Protein | Clone No. 812 | US20120009623 SEQ ID NO: 101 | 5633 |
| RSV412 | Light chain, F Protein | Clone No. 814 | US20120009623 SEQ ID NO: 102 | 5634 |
| RSV413 | Light chain, F Protein | Clone No. 816 | US20120009623 SEQ ID NO: 103 | 5635 |
| RSV414 | Light chain, F Protein | Clone No. 817 | US20120009623 SEQ ID NO: 104 | 5636 |
| RSV415 | Light chain, F Protein | Clone No. 818 | US20120009623 SEQ ID NO: 105 | 5637 |
| RSV416 | Light chain, F Protein | Clone No. 819 | US20120009623 SEQ ID NO: 106 | 5638 |
| RSV417 | Light chain, F Protein | Clone No. 824 | US20120009623 SEQ ID NO: 107 | 5639 |
| RSV41,8 | Light chain, F Protein | Clone No. 825 | US20120009623 SEQ ID NO: 108 | 5640 |
| RSV419 | Light chain, F Protein | Clone No. 827 | US20120009623 SEQ ID NO: 109 | 5641 |
| RSV420 | Light chain, F Protein | Clone No. 829 | US20120009623 SEQ ID NO: 110 | 5642 |
| RSV421 | Light chain, F Protein | Clone No. 830 | US20120009623 SEQ ID NO: 111 | 5643 |

TABLE 22-continued

Antibodies against Respiratory Syncytial Virus

| Antibody No. | Description | Antibody Name | Reference Information | SEQ ID NO |
|---|---|---|---|---|
| RSV422 | Light chain, F Protein | Clone No. 831 | US20120009623 SEQ ID NO: 112 | 5644 |
| RSV23 | Light chain, F Protein | Clone No. 835 | US20120009623 SEQ ID NO: 113 | 5645 |
| RSV424 | Light chain, F Protein | Clone No. 838 | US20120009623 SEQ ID NO: 114 | 5646 |
| RSV42S | Light chain, F Protein | Clone No. 841 | US20120009623 SEQ ID NO: 115 | 5647 |
| RSV426 | Light chain, F Protein | Clone No. 853 | US20120009623 SEQ ID NO: 116 | 5648 |
| RSV427 | Light chain, F Protein | Clone No. 855 | US20120009623 SEQ ID NO: 117 | 5649 |
| RSV428 | Light chain, F Protein | Clone No. 856 | US20120009623 SEQ ID NO: 118 | 5650 |
| RSV429 | Light chain, F Protein | Clone No. 857 | US20120009623 SEQ ID NO: 119 | 5651 |
| RSV430 | Light chain, F Protein | Clone No. 858 | US20120009623 SEQ ID NO: 120 | 5652 |
| RSV431 | Light chain, F Protein | Clone No. 859 | US20120009623 SEQ ID NO: 121 | 5653 |
| RSV432 | Light chain, F Protein | Clone No. 861 | US20120009623 SEQ ID NO: 122 | 5654 |
| RSV433 | Light chain, F Protein | Clone No. 863 | US20120009623 SEQ ID NO: 123 | 5655 |
| RSV434 | Light chain, F Protein | Clone No. 868 | US20120009623 SEQ ID NO: 124 | 5656 |
| RSV435 | Light chain, F Protein | Clone No. 870 | US20120009623 SEQ ID NO: 125 | 5657 |
| RSV436 | Light chain, F Protein | Clone No. 871 | US20120009623 SEQ ID NO: 126 | 5658 |
| RSV437 | Light chain, F Protein | Clone No. 880 | US2012000962 SEQ ID NO: 127 | 5659 |
| RSV438 | Light chain, F Protein | Clone No. 881 | US2012000923 SEQ ID NO: 128 | 5660 |
| RSV439 | Light chain, F Protein | Clone No. 884 | US20120009623 SEQ ID NO: 129 | 5661 |
| RSV440 | Light chain, F Protein | Clone No. 886 | US20120009623 SEQ ID NO: 130 | 5662 |
| RSV441 | Light chain, F Protein | Clone No. 888 | US20120009623 SEQ ID NO: 131 | 5663 |
| RSV442 | Light chain, F Protein | Clone No. 894 | US20120009623 SEQ ID NO: 132 | 5664 |
| RSV443 | Light chain, F Protein | | US20110027294 SEQ ID NO: 63 | 5665 |
| RSV444 | Light chain, F Protein | | US20110027294 SEQ ID NO: 64 | 5666 |
| RSV445 | Light chain, F Protein | | US20110027294 SEQ ID NO: 65 | 5667 |
| RSV446 | Light chain, F Protein | | US20110027294 SEQ ID NO: 66 | 5668 |
| RSV447 | Light chain, F Protein | | US20110027294 SEQ ID NO: 67 | 5669 |
| RSV448 | Light chain, F Protein | | US20110027294 SEQ ID NO: 68 | 5670 |
| RSV449 | Light chain, F Protein | | US20110027294 SEQ ID NO: 69 | 5671 |
| RSV450 | Light chain, F Protein | | US20110027294 SEQ ID NO: 70 | 5672 |
| RSV451 | Light chain, F Protein | | US20110027294 SEQ ID NO: 71 | 5673 |
| RSV452 | Light chain, F Protein | | US20110027294 SEQ ID NO: 72 | 5674 |
| RSV453 | Light chain, F Protein | | US20110027294 SEQ ID NO: 73 | 5675 |
| RSV454 | Light chain, F Protein | | US20110027294 SEQ ID NO: 81 | 5676 |
| RSV455 | Light chain, F Protein | | US20110027294 SEQ ID NO: 82 | 5677 |
| RSV456 | Light chain, F Protein | | US20110027294 SEQ ID NO: 83 | 5678 |
| RSV457 | Light chain, F Protein | | US20110027294 SEQ ID NO: 84 | 5679 |
| RSV458 | Light chain, F Protein | | US20110027294 SEQ ID NO: 85 | 5680 |

TABLE 22-continued

Antibodies against Respiratory Syncytial Virus

| Antibody No. | Description | Antibody Name | Reference Information | SEQ ID NO |
|---|---|---|---|---|
| RSV459 | Light chain, F Protein | | US20110027294 SEQ ID NO: 86 | 5681 |
| RSV460 | Light chain, F Protein | | US20110027294 SEQ ID NO: 87 | 5682 |
| RSV461 | Light chain, F Protein | | US20110027294 SEQ ID NO: 88 | 5683 |
| RSV462 | Light chain, F Protein | | US20110027294 SEQ ID NO: 89 | 5684 |
| RSV463 | Light chain, F Protein | | US20110027294 SEQ ID NO: 90 | 5685 |
| RSV464 | Light chain, F Protein | | US20110027294 SEQ ID NO: 91 | 5686 |
| RSV465 | Light chain, F Protein | | US20110027294 SEQ ID NO: 92 | 5687 |
| RSV466 | Light chain, F Protein | | US20110027294 SEQ ID NO: 93 | 5688 |
| RSV467 | Light chain, F Protein | | US20110027294 SEQ ID NO: 94 | 5689 |
| RSV468 | Light chain, F Protein | | US20110027294 SEQ ID NO: 95 | 5690 |
| RSV469 | Light chain, F Protein | | US20110027294 SEQ ID NO: 96 | 5691 |
| RSV470 | Light chain, F Protein | | US20110027294 SEQ ID NO: 97 | 5692 |
| RSV471 | Light chain, F Protein | | US20110027294 SEQ ID NO: 98 | 5693 |
| RSV472 | Light chain, F Protein | | US20110027294 SEQ ID NO: 99 | 5694 |
| RSV473 | Light chain, F Protein | | US20110027294 SEQ ID NO: 100 | 5695 |
| RSV474 | Light chain, F Protein | | US20110027294 SEQ ID NO: 101 | 5696 |
| RSV475 | Light chain, F Protein | | US20110027294 SEQ ID NO: 102 | 5697 |
| RSV476 | Light chain, F Protein | | US20110027294 SEQ ID NO: 103 | 5698 |
| RSV477 | Light chain, F Protein | | US20110027294 SEQ ID NO: 104 | 5699 |
| RSV478 | Light chain, F Protein | | US20110027294 SEQ ID NO: 105 | 5700 |
| RSV479 | Light chain, F Protein | | US20110027294 SEQ ID NO: 106 | 5701 |
| RSV480 | Light chain, F Protein | | US20110027294 SEQ ID NO: 107 | 5702 |
| RSV481 | Light chain, F Protein | | US20110027294 SEQ ID NO: 108 | 5703 |
| RSV482 | Light chain, F Protein | | US20110027294 SEQ ID NO: 109 | 5704 |
| RSV483 | Light chain, F Protein | | US20110027294 SEQ ID NO: 110 | 5705 |
| RSV484 | Light chain, F Protein | | US20110027294 SEQ ID NO: 111 | 5706 |
| RSV485 | Light chain, F Protein | | US20110027294 SEQ ID NO: 112 | 5707 |
| RSV486 | Light chain, F Protein | Gλ-1A | US20050175986 SEQ ID NO: 9 | 5708 |
| RSV487 | Light chain, F Protein | A construct | US20050175986 SEQ ID NO: 11 | 5709 |
| RSV488 | Light chain, F Protein | B construct | US20050175986 SEQ ID NO: 12 | 5710 |
| RSV489 | Light chain, F Protein | hu19A | US20050019758; WO1998019704 SEQ ID NO: 10 | 5711 |
| RSV490 | Light chain, F Protein | hu19B | US20050019758; WO1998019704 SEQ ID NO: 11 | 5712 |
| RSV491 | Light chain, F Protein | hu19C | US20050019758; WO1998019704 SEQ ID NO: 12 | 5713 |
| RSV492 | Light chain, F Protein | hu19D | US20050019758; WO1998019704 SEQ ID NO: 13 | 5714 |
| RSV493 | Light chain, F Protein | RSV19 | EP636182; WO1993020210; SEQ ID NO: 12 | 5715 |

TABLE 22-continued

Antibodies against Respiratory Syncytial Virus

| Antibody No. | Description | Antibody Name | Reference Information | SEQ ID NO |
|---|---|---|---|---|
| RSV494 | Light chain, F Protein, | | WO19922004381 | 5716 |
| RSV495 | Light chain variable region, F Protein | P1212 | US20140044719 SEQ ID NO: 127 | 5717 |
| RSV496 | Light chain variable region, F Protein | P12f4 | US20140044719 SEQ ID NO: 134 | 5718 |
| RSV497 | Light chain variable region, F Protein | P11d4 | US20140044719 SEQ ID NO: 140 | 5719 |
| RSV498 | Light chain variable region, F Protein | A1e9 | US20140044719 SEQ ID NO: 146 | 5720 |
| RSV499 | Light chain variable region, F Protein | A12a6 | US20140044719 SEQ ID NO: 152 | 5721 |
| RSV500 | Light chain variable region, F Protein | A13c4 | US20140044719 SEQ ID NO: 158 | 5722 |
| RSV501 | Light chain variable region, F Protein | A17d4 | US20140044719 SEQ ID NO: 164 | 5723 |
| RSV502 | Light chain variable region, F Protein | A4B4 | US20140044719 SEQ ID NO: 169 | 5724 |
| RSV503 | Light chain variable region, F Protein | A8c7 | US20140044719 SEQ ID NO: 174 | 5725 |
| RSV504 | Light chain variable region, F Protein | IX-493L1FR | US20140044719 SEQ ID NO: 178 | 5726 |
| RSV505 | Light chain variable region, F Protein | M3H9 | US20140044719 SEQ ID NO: 180 | 5727 |
| RSV506 | Light chain variable region, F Protein | B21M | US20110027294 SEQ ID NO: 51 | 5728 |
| RSV507 | Light chain variable region, F Protein | 101F | US20110027294 SEQ ID NO: 6 | 5729 |
| RSV508 | Light chain variable region, F Protein | HNK20 | EP1720908; WO2005079479 SEQ ID NO: 2 | 5730 |
| RSV509 | Light chain variable region, F Protein | P1212 | US20140044719 SEQ ID NO: 128 | 5731 |
| RSV510 | Light chain variable region, F Protein | P12f4 | US20140044719 SEQ ID NO: 135 | 5732 |
| RSV511 | Light chain variable region, F Protein | P11d4 | US20140044719 SEQ ID NO: 141 | 5733 |
| RSV512 | Light chain variable region, F Protein | A1e9 | US20140044719 SEQ ID NO: 147 | 5734 |
| RSV513 | Light chain variable region, F Protein | A12a6 | US20140044719 SEQ ID NO: 153 | 5735 |
| RSV514 | Light chain variable region, F Protein | A13c4 | US20140044719 SEQ ID NO: 159 | 5736 |
| RSV515 | Light chain variable region, F Protein | A17d4 | US20140044719 SEQ ID NO: 165 | 5737 |
| RSV516 | Light chain variable region, F Protein | A4B4 | US20140044719 SEQ ID NO: 170 | 5738 |
| RSV517 | Light chain variable region, F Protein | A8c7 | US20140044719 SEQ ID NO: 175 | 5739 |
| RSV518 | Light chain variable region, F Protein | IX-493L1FR | US20140044719 SEQ ID NO: 179 | 5740 |
| RSV519 | Light chain variable region, F Protein | H1 H3564P | WO2014159822 SEQ ID NO: 10 | 5741 |
| RSV520 | Light chain variable region, F Protein | H1 H3565P | WO2014159822 SEQ ID NO: 26 | 5742 |
| RSV521 | Light chain variable region, F Protein | H1 H3566P | WO2014159822 SEQ ID NO: 42 | 5743 |
| RSV522 | Light chain variable region, F Protein | H1 H3567P | WO2014159822 SEQ ID NO: 58 | 5744 |
| RSV523 | Light chain variable region, F Protein | H1 H3581 P | WO2014159822 SEQ ID NO: 74 | 5745 |
| RSV524 | Light chain variable region, F Protein | H1 H3583P | WO2014159822 SEQ ID NO: 90 | 5746 |
| RSV525 | Light chain variable region, F Protein | H1 H3589P | WO2014159822 SEQ ID NO: 106 | 5747 |
| RSV526 | Light chain variable region, F Protein | H1 H3591 P | WO2014159822 SEQ ID NO: 122 | 5748 |
| RSV527 | Light chain variable region, F Protein | H1 H3592P | WO2014159822 SEQ ID NO: 138 | 5749 |
| RSV528 | Light chain variable region, F Protein | H1 H3597P | WO2014159822 SEQ ID NO: 154 | 5750 |
| RSV529 | Light chain variable region, F Protein | H1 H3598P | WO2014159822 SEQ ID NO: 170 | 5751 |
| RSV530 | Light chain variable region, F Protein | H1 H3603P | WO2014159822 SEQ ID NO: 186 | 5752 |
| RSV531 | Light chain variable region, F Protein | H1 H3604P | WO2014159822 SEQ ID NO: 202 | 5753 |

TABLE 22-continued

Antibodies against Respiratory Syncytial Virus

| Antibody No. | Description | Antibody Name | Reference Information | SEQ ID NO |
|---|---|---|---|---|
| RSV532 | Light chain variable region, F Protein | H1 H3605P | WO2014159822 SEQ ID NO: 218 | 5754 |
| RSV533 | Light chain variable region, F Protein | H1 H3607P | WO2014159822 SEQ ID NO: 234 | 5755 |
| RSV534 | Light chain variable region, F Protein | H1 H3608P2 | WO2014159822 SEQ ID NO: 250 | 5756 |
| RSV535 | Light chain variable region, F Protein | H1 H3592P2 | WO2014159822 SEQ ID NO: 266 | 5757 |
| RSV536 | Light chain variable region, F Protein | H1 H3592P3 | WO2014159822 SEQ ID NO: 282 | 5758 |
| RSV537 | Light chain variable region, F Protein | H1 M3621 N | WO2014159822 SEQ ID NO: 298 | 5759 |
| RSV538 | Light chain variable region, F Protein | H1 M3622N | WO2014159822 SEQ ID NO: 314 | 5760 |
| RSV539 | Light chain variable region, F Protein | H1 M2634N | WO2014159822 SEQ ID NO: 330 | 5761 |
| RSV540 | Light chain variable region, F Protein | H1 M3627N | WO2014159822 SEQ ID NO: 346 | 5762 |
| RSV541 | Light chain variable region, F Protein | Gλ-1 | US20050175986 SEQ ID NO: 2 | 5763 |
| RSV542 | Light chain variable region, F Protein | MAb1129 | US20140093501 SEQ ID NO: 35 | 5764 |
| RSV543 | super humanized kappa light chain based on HNK20, F protein | SHVl1 | EP1720908; WO2005079479 SEQ ID NO: 10 | 5765 |
| RSV544 | super humanized kappa light chain based on HNK20, F protein | SHVl2 | EP1720908; WO2005079479 SEQ ID NO: 11 | 5766 |
| RSV545 | super humanized kappa light chain based on HNK20, F protein | SHVl3 | EP1720908; WO2005079479 SEQ ID NO: 12 | 5767 |
| RSV546 | super humanized kappa light chain based on HNK20, F protein | SHVl4 | EP1720908; WO2005079479 SEQ ID NO: 13 | 5768 |
| RSV547 | super humanized kappa light chain based on HNK20, F protein | SHVl5 | EP1720908; WO2005079479 SEQ ID NO: 14 | 5769 |
| RSV548 | super humanized kappa light chain based on HNK20, F protein | SHVl6 | EP1720908; WO2005079479 SEQ ID NO: 15 | 5770 |
| RSV549 | Light chain variable region, F Protein | B4 | EP636182; WO1993020210; SEQ ID NO: 1 | 5771 |
| RSV550 | Light chain variable region, F Protein | B13/14 | EP636182; WO1993020210; SEQ ID NO: 2 | 5772 |
| RSV551 | Light chain variable region, F Protein | RF-1 | EP854730; WO1996040252; FIG. 7A | 5773 |
| RSV552 | Light chain variable region, F Protein | RF-2 | EP854730; WO1996040252; FIG. 8A | 5774 |
| RSV553 | Light chain variable region Kappa, G protein | CB058.1 | WO2014170257 SEQ ID NO: 38 | 5775 |
| RSV554 | Light chain variable region Kappa, G protein | CB048.3 | WO2014170257 SEQ ID NO: 40 | 5776 |
| RSV555 | Light chain variable region Kappa, G protein | CB010.7 | WO2014170257 SEQ ID NO: 42 | 5777 |
| RSV556 | Light chain variable region Kappa, G protein | CB003.1 | WO2014170257 SEQ ID NO: 44 | 5778 |
| RSV557 | Light chain variable region Kappa, G protein | CB028.2 | WO2014170257 SEQ ID NO: 46 | 5779 |
| RSV558 | Light chain variable region Kappa, G protein | CB002.1 | WO2014170257 SEQ ID NO: 48 | 5780 |
| RSV559 | Light chain, G Protein | 1F12 | US8273354 SEQ ID NO: 42 | 5781 |
| RSV560 | Light chain, G Protein | 3G12 | US8273354 SEQ ID NO: 43 | 5782 |
| RSV561 | Light chain, G Protein | 1A5 | US8273354 SEQ ID NO: 44 | 5783 |
| RSV562 | Light chain, G Protein | 3D3 | US8273354 SEQ ID NO: 45 | 5784 |
| RSV563 | Light chain, G Protein | 1G1 | US8273354 SEQ ID NO: 46 | 5785 |
| RSV564 | Light chain, G Protein | 2B11 | US8273354 SEQ ID NO: 47 | 5786 |
| RSV565 | Light chain, G Protein | 5D8 | US8273354 SEQ ID NO: 48 | 5787 |
| RSV566 | Light chain, G Protein | 2D10 | US8273354 SEQ ID NO: 49 | 5788 |
| RSV567 | Light chain, G Protein | 3F9 | US8273354 SEQ ID NO: 50 | 5789 |
| RSV568 | Light chain, G Protein | 1D4 | US8273354 SEQ ID NO: 51 | 5790 |
| RSV569 | Light chain, G Protein | 1G8 | US8273354 SEQ ID NO: 52 | 5791 |
| RSV570 | Light chain, G Protein | 6A12 | US8273354 SEQ ID NO: 53 | 5792 |
| RSV571 | Light chain, G Protein | 10C6 | US8273354 SEQ ID NO: 54 | 5793 |
| RSV572 | Light chain, G Protein | Hu 131-2G | US8273354 SEQ ID NO: 55 | 5794 |

TABLE 22-continued

Antibodies against Respiratory Syncytial Virus

| Antibody No. | Description | Antibody Name | Reference Information | SEQ ID NO |
|---|---|---|---|---|
| RSV573 | Light chain, G Protein | AT46 | US20150004155 SEQ ID NO: 127 | 5795 |
| RSV574 | Light chain, G Protein | AT32 | US20150004155 SEQ ID NO: 128 | 5796 |
| RSV575 | Light chain, G Protein | AT33 | US20150004155 SEQ ID NO: 129 | 5797 |
| RSV576 | Light chain, G Protein | AT34 | US20150004155 SEQ ID NO: 130 | 5798 |
| RSV577 | Light chain, G Protein | AT35 | US20150004155 SEQ ID NO: 131 | 5799 |
| RSV578 | Light chain, G Protein | AT36 | US20150004155 SEQ ID NO: 132 | 5800 |
| RSV579 | Light chain, G Protein | AT37 | US20150004155 SEQ ID NO: 133 | 5801 |
| RSV580 | Light chain, G Protein | AT39 | US20150004155 SEQ ID NO: 134 | 5802 |
| RSV581 | Light chain, G Protein | AT40 | US20150004155 SEQ ID NO: 135 | 5803 |
| RSV582 | Light chain, G Protein | AT42 | US20150004155 SEQ ID NO: 136 | 5804 |
| RSV583 | Light chain, G Protein | AT43 | US20150004155 SEQ ID NO: 137 | 5805 |
| RSV584 | Light chain, G Protein | AT44 | US20150004155 SEQ ID NO: 138 | 5806 |
| RSV585 | Light chain, G Protein | AT45 | US20150004155 SEQ ID NO: 139 | 5807 |
| RSV586 | Light chain, G Protein | AT47 | US20150004155 SEQ ID NO: 140 | 5808 |
| RSV587 | Light chain, G Protein | AT49 | US20150004155 SEQ ID NO: 141 | 5809 |
| RSV588 | Light chain, G Protein | AT50 | US20150004155 SEQ ID NO: 142 | 5810 |
| RSV589 | Light chain, G Protein | AT51 | US20150004155 SEQ ID NO: 143 | 5811 |
| RSV590 | Light chain variable region, G Protein | CB017.3L | WO2014170258 SEQ ID NO: 74 | 5812 |
| RSV591 | Light chain variable region, G Protein | CB017.5L | WO2014170258 SEQ ID NO: 76 | 5813 |
| RSV592 | Light chain variable region, G Protein | CB028.1 | WO2014170258 SEQ ID NO: 78 | 5814 |
| RSV593 | Light chain variable region, G Protein | CB030.1 | WO2014170258 SEQ ID NO: 80 | 5815 |
| RSV594 | Light chain variable region, G Protein | CB047.1 | WO2014170258 SEQ ID NO: 82 | 5816 |
| RSV595 | Light chain variable region, G Protein | CB047.2 | WO2014170258 SEQ ID NO: 84 | 5817 |
| RSV596 | Light chain variable region, G Protein | CB065.1 | WO2014170258 SEQ ID NO: 86 | 5818 |
| RSV597 | Light chain variable region, G Protein | CB071.1L | WO2014170258 SEQ ID NO: 88 | 5819 |
| RSV598 | Light chain variable region, G Protein | CB072.1L | WO2014170258 SEQ ID NO: 90 | 5820 |
| RSV599 | Light chain variable region, G Protein | CB073.1L | WO2014170258 SEQ ID NO: 92 | 5821 |
| RSV600 | Light chain variable region, G Protein | CB076.2L | WO2014170258 SEQ ID NO: 94 | 5822 |
| RSV601 | Light chain variable region, G Protein | CB079.1 | WO2014170258 SEQ ID NO: 96 | 5823 |
| RSV602 | Light chain, human metapneumovirus fusion protein with neutralizing antibody identifies a pneumovirus antigenic site | | Wen,X., "Structure of the human metapneumovirus fusion protein with neutralizing antibody identifies a pneumovirus antigenic site", Nat. Struct. Mol. Biol. 19 (4), 461-463 (2012), NCBI Accession # 4DAG_L(213 aa) | 5824 |
| RSV603 | Light chain | AM14 | US20140377279 SEQ ID NO: 79 | 5825 |
| RSV604 | Light chain | AM16 | US20140377279 SEQ ID NO: 86 | 5826 |
| RSV605 | Light chain | AM23 | US20140377279 SEQ ID NO: 93 | 5827 |
| RSV606 | Light chain | D25 | US20140377279 SEQ ID NO: 8 | 5828 |
| RSV607 | Light chain | AFFF | US7635568 SEQ ID NO: 211 | 5829 |
| RSV608 | Light chain | P12f2 | US7635568 SEQ ID NO: 213 | 5830 |

TABLE 22-continued

Antibodies against Respiratory Syncytial Virus

| Antibody No. | Description | Antibody Name | Reference Information | SEQ ID NO |
|---|---|---|---|---|
| RSV609 | Light chain | P12f4 | US7635568 SEQ ID NO: 215 | 5831 |
| RSV610 | Light chain | P11d4 | US7635568 SEQ ID NO: 217 | 5832 |
| RSV611 | Light chain | Ale9 | US7635568 SEQ ID NO: 219 | 5833 |
| RSV612 | Light chain | A12a6 | US7635568 SEQ ID NO: 221 | 5834 |
| RSV613 | Light chain | A13c4 | US7635568 SEQ ID NO: 223 | 5835 |
| RSV614 | Light chain | A17d4 | US7635568 SEQ ID NO: 225 | 5836 |
| RSV615 | Light chain | A4B4 | US7635568 SEQ ID NO: 227 | 5837 |
| RSV616 | Light chain | A8c7 | US7635568 SEQ ID NO: 229 | 5838 |
| RSV617 | Light chain | 1X-493-L1FR | US7635568 SEQ ID NO: 231 | 5839 |
| RSV618 | Light chain | H3-3F4, DG | US7635568 SEQ ID NO: 233 | 5840 |
| RSV619 | Light chain | M3H9 | US7635568 SEQ ID NO: 235 | 5841 |
| RSV620 | Light chain | Y10H6 | US7635568 SEQ ID NO: 237 | 5842 |
| RSV621 | Light chain | DG | US7635568 SEQ ID NO: 239 | 5843 |
| RSV622 | Light chain | AFFF(1) | US7635568 SEQ ID NO: 241 | 5844 |
| RSV623 | Light chain | 6H8 | US7635568 SEQ ID NO: 243 | 5845 |
| RSV624 | Light chain | L1-7E5 | US7635568 SEQ ID NO: 245 | 5846 |
| RSV625 | Light chain | L2-15B10 | US7635568 SEQ ID NO: 247 | 5847 |
| RSV626 | Light chain | A13a11 | US7635568 SEQ ID NO: 249 | 5848 |
| RSV627 | Light chain | A1h5 | US7635568 SEQ ID NO: 251 | 5849 |
| RSV628 | Light chain | A4B4(1) | US7635568 SEQ ID NO: 253 | 5850 |
| RSV629 | Light chain | A4B4L1FR-S28R | US7635568 SEQ ID NO: 255 | 5851 |
| RSV630 | Light chain | A4B4-F52S | US7635568 SEQ ID NO: 257 | 5852 |
| RSV631 | Light chain variable region | AFFF | US7635568 SEQ ID NO: 13 | 5853 |
| RSV632 | Light chain variable region | P12f2 | US7635568 SEQ ID NO: 21 | 5854 |
| RSV633 | Light chain variable region | P12f4 | US7635568 SEQ ID NO: 26 | 5855 |
| RSV634 | Light chain variable region | P11d4 | US7635568 SEQ ID NO: 30 | 5856 |
| RSV635 | Light chain variable region | Ale9 | US7635568 SEQ ID NO: 34 | 5857 |
| RSV636 | Light chain variable region | A12a6 | US7635568 SEQ ID NO: 38 | 5858 |
| RSV637 | Light chain variable region | A13c4 | US7635568 SEQ ID NO: 42 | 5859 |
| RSV638 | Light chain variable region | A17d4 | US7635568 SEQ ID NO: 46 | 5860 |
| RSV639 | Light chain variable region | A4B4 | US7635568 SEQ ID NO: 49 | 5861 |
| RSV640 | Light chain variable region | A8c7 | US7635568 SEQ ID NO: 52 | 5862 |
| RSV641 | Light chain variable region | 1X-493L1FR | US7635568 SEQ ID NO: 54 | 5863 |
| RSV642 | Light chain variable region | H3-3F4, DG | US7635568 SEQ ID NO: 56 | 5864 |
| RSV643 | Light chain variable region | M3H9 | US7635568 SEQ ID NO: 70 | 5865 |
| RSV644 | Light chain variable region | Y10H6 | US7635568 SEQ ID NO: 58 | 5866 |
| RSV645 | Light chain variable region | AFFF(1) | US7635568 SEQ ID NO: 60 | 5867 |
| RSV646 | Light chain variable region | 6H8 | US7635568 SEQ ID NO: 62 | 5868 |
| RSV647 | Light chain variable region | L1-7E5 | US7635568 SEQ ID NO: 64 | 5869 |
| RSV648 | Light chain variable region | L2-15B10 | US7635568 SEQ ID NO: 65 | 5870 |
| RSV649 | Light chain variable region | A13a11 | US7635568 SEQ ID NO: 68 | 5871 |
| RSV650 | Light chain variable region | A1h5 | US7635568 SEQ ID NO: 71 | 5872 |
| RSV651 | Light chain variable region | A4B4(1) | US7635568 SEQ ID NO: 74 | 5873 |
| RSV652 | Light chain variable region | A4B4L1FR-S28R | US7635568 SEQ ID NO: 11 | 5874 |
| RSV653 | Light chain variable region | A4B4-F52S | US7635568 SEQ ID NO: 76 | 5875 |
| RSV654 | Light chain variable region | 6H; 11H; 21H; 22H; and 23H | US7364737 SEQ ID NO: 21 | 5876 |
| RSV655 | Light chain variable region | 13H and 19H | US7364737 SEQ ID NO: 22 | 5877 |
| RSV656 | Light chain variable region | 6L; 11L; 21L; and 22L | US7364737 SEQ ID NO: 23 | 5878 |
| RSV657 | Light chain variable region | 23L | US7364737 SEQ ID NO: 24 | 5879 |
| RSV658 | Light chain variable region | 13L and 19L | US7364737 SEQ ID NO: 25 | 5880 |
| RSV659 | Light chain variable region | | US7364742 SEQ ID NO: 9 | 5881 |
| RSV660 | Light chain variable region | | US7364742 SEQ ID NO: 10 | 5882 |
| RSV661 | Light chain variable region | | US7364742 SEQ ID NO: 11 | 5883 |
| RSV662 | Light chain variable region | | US7364742 SEQ ID NO: 12 | 5884 |
| RSV663 | Light chain variable region | D2E7 | EP1807111; WO2006041970 SEQ ID NO: 1 | 5885 |
| RSV664 | Light chain variable region | 2SD4 | EP1807111; WO2006041970 SEQ ID NO: 9 | 5886 |
| RSV665 | Light chain variable, M2 1 antigen | 8A4/G9-IgG | US20140348858 SEQ ID NO: 4 | 5887 |
| RSV666 | Light chain, Pre fusion RSV F protein | HMB2435 | WO2015010792 SEQ ID NO: 14 | 5888 |
| RSV667 | Light chain, Pre fusion RSV F protein | HMB2437 | WO2015010792 SEQ ID NO: 30 | 5889 |
| RSV668 | Light chain, Pre fusion RSV F protein | HMB2416 | WO2015010792 SEQ ID NO: 46 | 5890 |
| RSV669 | Light chain, Pre fusion RSV F protein | HMB2437 | WO2015010792 SEQ ID NO: 86 | 5891 |
| RSV670 | Light chain, Pre fusion RSV F protein | CR9501 | WO2014202570 SEQ ID NO: 61 | 5892 |
| RSV671 | Light chain, Pre fusion RSV F protein | CR9502 | WO2014202570 SEQ ID NO: 65 | 5893 |

TABLE 22-continued

Antibodies against Respiratory Syncytial Virus

| Antibody No. | Description | Antibody Name | Reference Information | SEQ ID NO |
|---|---|---|---|---|
| RSV672 | Light chain 1, Pre fusion RSV F protein | HMB2432 | WO2015010792 SEQ ID NO: 62 | 5894 |
| RSV673 | Light chain FR GL, Pre fusion RSV F protein | HMB2432 | WO2015010792 SEQ ID NO: 66 | 5895 |
| RSV674 | Light chain 2, Pre fusion RSV F protein | HMB2435 | WO2015010792 SEQ ID NO: 76 | 5896 |
| RSV675 | derived Ig variable region amino acid sequence, F protein | RSV19VH | EP636182; WO1993020210; SEQ ID NO: 13 | 5897 |
| RSV676 | derived Ig variable region amino acid sequence, F protein | pHuRSV19VH | EP636182; WO1993020210; SEQ ID NO: 14 | 5898 |
| RSV677 | derived Ig variable region amino acid sequence, F protein | pHuRSV19VHFNS | EP636182; WO1993020210; SEQ ID NO: 15 | 5899 |
| RSV678 | derived Ig variable region amino acid sequence, F protein | pHuRSV19VHNIK | EP636182; WO1993020210; SEQ ID NO: 16 | 5900 |
| RSV679 | derived Ig variable region amino acid sequence, F protein | pHuRSV19VK | EP636182; WO1993020210; SEQ ID NO: 17 | 5901 |
| RSV680 | Nanobody binding to RSV F protein | LG202A10 | US20110182897 SEQ ID NO: 126 | 5902 |
| RSV681 | Nanobody binding to RSV F protein | LG202A12 | US20110182897 SEQ ID NO: 127 | 5903 |
| RSV682 | Nanobody binding to RSV F protein | LG202A5 | US20110182897 SEQ ID NO: 128 | 5904 |
| RSV683 | Nanobody binding to RSV F protein | LG202A9 | US20110182897 SEQ ID NO: 129 | 5905 |
| RSV684 | Nanobody binding to RSV F protein | LG202B10 | US20110182897 SEQ ID NO: 130 | 5906 |
| RSV685 | Nanobody binding to RSV F protein | LG202B7 | US20110182897 SEQ ID NO: 131 | 5907 |
| RSV686 | Nanobody binding to RSV F protein | LG202B8 | US20110182897 SEQ ID NO: 132 | 5908 |
| RSV687 | Nanobody binding to RSV F protein | LG202B9 | US20110182897 SEQ ID NO: 133 | 5909 |
| RSV688 | Nanobody binding to RSV F protein | LG202C1 | US20110182897 SEQ ID NO: 134 | 5910 |
| RSV689 | Nanobody binding to RSV F protein | LG202C11 | US20110182897 SEQ ID NO: 135 | 5911 |
| RSV690 | Nanobody binding to RSV F protein | LG202C2 | US20110182897 SEQ ID NO: 136 | 5912 |
| RSV691 | Nanobody binding to RSV F protein | LG202C7 | US20110182897 SEQ ID NO: 137 | 5913 |
| RSV692 | Nanobody binding to RSV F protein | LG202C8 | US20110182897 SEQ ID NO: 138 | 5914 |
| RSV693 | Nanobody binding to RSV F protein | LG202C9 | US20110182897 SEQ ID NO: 139 | 5915 |
| RSV694 | Nanobody binding to RSV F protein | LG202D5 | US20110182897 SEQ ID NO: 140 | 5916 |
| RSV695 | Nanobody binding to RSV F protein | LG202D7 | US20110182897 SEQ ID NO: 141 | 5917 |
| RSV696 | Nanobody binding to RSV F protein | LG202D8 | US20110182897 SEQ ID NO: 142 | 5918 |
| RSV697 | Nanobody binding to RSV F protein | LG202E11 | US20110182897 SEQ ID NO: 143 | 5919 |
| RSV698 | Nanobody binding to RSV F protein | LG202E2 | US20110182897 SEQ ID NO: 144 | 5920 |
| RSV699 | Nanobody binding to RSV F protein | LG202E5 | US20110182897 SEQ ID NO: 145 | 5921 |
| RSV700 | Nanobody binding to RSV F protein | LG202E6 | US20110182897 SEQ ID NO: 146 | 5922 |
| RSV701 | Nanobody binding to RSV F protein | LG202E7 | US20110182897 SEQ ID NO: 147 | 5923 |
| RSV702 | Nanobody binding to RSV F protein | LG202F10 | US20110182897 SEQ ID NO: 148 | 5924 |
| RSV703 | Nanobody binding to RSV F protein | LG202F12 | US20110182897 SEQ ID NO: 149 | 5925 |
| RSV704 | Nanobody binding to RSV F protein | LG202F3 | US20110182897 SEQ ID NO: 150 | 5926 |
| RSV705 | Nanobody binding to RSV F protein | LG202F4 | US20110182897 SEQ ID NO: 151 | 5927 |
| RSV706 | Nanobody binding to RSV F protein | LG202F8 | US20110182897 SEQ ID NO: 152 | 5928 |
| RSV707 | Nanobody binding to RSV F protein | LG202G11 | US20110182897 SEQ ID NO: 153 | 5929 |
| RSV708 | Nanobody binding to RSV F protein | LG202G3 | US20110182897 SEQ ID NO: 154 | 5930 |

TABLE 22-continued

Antibodies against Respiratory Syncytial Virus

| Antibody No. | Description | Antibody Name | Reference Information | SEQ ID NO |
|---|---|---|---|---|
| RSV709 | Nanobody binding to RSV F protein | LG202G8 | US20110182897 SEQ ID NO: 155 | 5931 |
| RSV710 | Nanobody binding to RSV F protein | LG202H2 | US20110182897 SEQ ID NO: 156 | 5932 |
| RSV711 | Nanobody binding to RSV F protein | LG202H8 | US20110182897 SEQ ID NO: 157 | 5933 |
| RSV712 | Nanobody binding to RSV F protein | LG191B9 | US20110182897 SEQ ID NO: 158 | 5934 |
| RSV713 | Nanobody binding to RSV F protein | LG191D3 | US20110182897 SEQ ID NO: 159 | 5935 |
| RSV714 | Nanobody binding to RSV F protein | LG192A8 | US20110182897 SEQ ID NO: 160 | 5936 |
| RSV715 | Nanobody binding to RSV F protein | LG192B1 | US20110182897 SEQ ID NO: 161 | 5937 |
| RSV716 | Nanobody binding to RSV F protein | LG192C10 | US20110182897 SEQ ID NO: 162 | 5938 |
| RSV717 | Nanobody binding to RSV F protein | LG192C4 | US20110182897 SEQ ID NO: 163 | 5939 |
| RSV718 | Nanobody binding to RSV F protein | LG192C6 | US20110182897 SEQ ID NO: 164 | 5940 |
| RSV719 | Nanobody binding to RSV F protein | LG192D3 | US20110182897 SEQ ID NO: 165 | 5941 |
| RSV720 | Nanobody binding to RSV F protein | LG191E4 | US20110182897 SEQ ID NO: 166 | 5942 |
| RSV721 | Nanobody binding to RSV F protein | LG192F2 | US20110182897 SEQ ID NO: 167 | 5943 |
| RSV722 | Nanobody binding to RSV F protein | LG192H1 | US20110182897 SEQ ID NO: 168 | 5944 |
| RSV723 | Nanobody binding to RSV F protein | LG192H2 | US20110182897 SEQ ID NO: 169 | 5945 |
| RSV724 | Nanobody binding to RSV F protein | LG20610B | US20110182897 SEQ ID NO: 170 | 5946 |
| RSV725 | Nanobody binding to RSV F protein | LG20610C | US20110182897 SEQ ID NO: 171 | 5947 |
| RSV726 | Nanobody binding to RSV F protein | LG20610D | US20110182897 SEQ ID NO: 172 | 5948 |
| RSV727 | Nanobody binding to RSV F protein | LG20610E | US20110182897 SEQ ID NO: 173 | 5949 |
| RSV728 | Nanobody binding to RSV F protein | LG20610F | US20110182897 SEQ ID NO: 174 | 5950 |
| RSV729 | Nanobody binding to RSV F protein | LG20611D | US20110182897 SEQ ID NO: 175 | 5951 |
| RSV730 | Nanobody binding to RSV F protein | LG20611H | US20110182897 SEQ ID NO: 176 | 5952 |
| RSV731 | Nanobody binding to RSV F protein | LG20612F | US20110182897 SEQ ID NO: 177 | 5953 |
| RSV732 | Nanobody binding to RSV F protein | LG2062A | US20110182897 SEQ ID NO: 178 | 5954 |
| RSV733 | Nanobody binding to RSV F protein | LG2062C | US20110182897 SEQ ID NO: 179 | 5955 |
| RSV734 | Nanobody binding to RSV F protein | LG2062E | US20110182897 SEQ ID NO: 180 | 5956 |
| RSV735 | Nanobody binding to RSV F protein | LG2062F | US20110182897 SEQ ID NO: 181 | 5957 |
| RSV736 | Nanobody binding to RSV F protein | LG2062G | US20110182897 SEQ ID NO: 182 | 5958 |
| RSV737 | Nanobody binding to RSV F protein | LG2062H | US20110182897 SEQ ID NO: 183 | 5959 |
| RSV738 | Nanobody binding to RSV F protein | LG2063A | US20110182897 SEQ ID NO: 184 | 5960 |
| RSV739 | Nanobody binding to RSV F protein | LG2063B | US20110182897 SEQ ID NO: 185 | 5961 |
| RSV740 | Nanobody binding to RSV F protein | LG2063C | US20110182897 SEQ ID NO: 186 | 5962 |
| RSV741 | Nanobody binding to RSV F protein | LG2063D | US20110182897 SEQ ID NO: 187 | 5963 |
| RSV742 | Nanobody binding to RSV F protein | LG2063E | US20110182897 SEQ ID NO: 188 | 5964 |
| RSV743 | Nanobody binding to RSV F protein | LG2063F | US20110182897 SEQ ID NO: 189 | 5965 |
| RSV744 | Nanobody binding to RSV F protein | LG2064D | US20110182897 SEQ ID NO: 190 | 5966 |
| RSV745 | Nanobody binding to RSV F protein | LG2064G | US20110182897 SEQ ID NO: 191 | 5967 |

TABLE 22-continued

Antibodies against Respiratory Syncytial Virus

| Antibody No. | Description | Antibody Name | Reference Information | SEQ ID NO |
|---|---|---|---|---|
| RSV746 | Nanobody binding to RSV F protein | LG2065A | US20110182897 SEQ ID NO: 192 | 5968 |
| RSV747 | Nanobody binding to RSV F protein | LG2065E | US20110182897 SEQ ID NO: 193 | 5969 |
| RSV748 | Nanobody binding to RSV F protein | LG2066A | US20110182897 SEQ ID NO: 194 | 5970 |
| RSV749 | Nanobody binding to RSV F protein | LG2066D | US20110182897 SEQ ID NO: 195 | 5971 |
| RSV750 | Nanobody binding to RSV F protein | LG2067B | US20110182897 SEQ ID NO: 196 | 5972 |
| RSV751 | Nanobody binding to RSV F protein | LG2067C | US20110182897 SEQ ID NO: 197 | 5973 |
| RSV752 | Nanobody binding to RSV F protein | LG2067E | US20110182897 SEQ ID NO: 198 | 5974 |
| RSV753 | Nanobody binding to RSV F protein | LG2067G | US20110182897 SEQ ID NO: 199 | 5975 |
| RSV754 | Nanobody binding to RSV F protein | LG2067H | US20110182897 SEQ ID NO: 200 | 5976 |
| RSV755 | Nanobody binding to RSV F protein | LG20711A | US20110182897 SEQ ID NO: 201 | 5977 |
| RSV756 | Nanobody binding to RSV F protein | LG20711B | US20110182897 SEQ ID NO: 202 | 5978 |
| RSV757 | Nanobody binding to RSV F protein | LG20711D | US20110182897 SEQ ID NO: 203 | 5979 |
| RSV758 | Nanobody binding to RSV F protein | LG20711E | US20110182897 SEQ ID NO: 204 | 5980 |
| RSV759 | Nanobody binding to RSV F protein | LG20711F | US20110182897 SEQ ID NO: 205 | 5981 |
| RSV760 | Nanobody binding to RSV F protein | LG20711G | US20110182897 SEQ ID NO: 206 | 5982 |
| RSV761 | Nanobody binding to RSV F protein | LG20711H | US20110182897 SEQ ID NO: 207 | 5983 |
| RSV762 | Nanobody binding to RSV F protein | LG2071A | US20110182897 SEQ ID NO: 208 | 5984 |
| RSV763 | Nanobody binding to RSV F protein | LG2071B | US20110182897 SEQ ID NO: 209 | 5985 |
| RSV764 | Nanobody binding to RSV F protein | LG2071C | US20110182897 SEQ ID NO: 210 | 5986 |
| RSV765 | Nanobody binding to RSV F protein | LG207D1 | US20110182897 SEQ ID NO: 211 | 5987 |
| RSV766 | Nanobody binding to RSV F protein | LG2071E | US20110182897 SEQ ID NO: 212 | 5988 |
| RSV767 | Nanobody binding to RSV F protein | LG2071F | US20110182897 SEQ ID NO: 213 | 5989 |
| RSV768 | Nanobody binding to RSV F protein | LG2074A | US20110182897 SEQ ID NO: 214 | 5990 |
| RSV769 | Nanobody binding to RSV F protein | LG2074B | US20110182897 SEQ ID NO: 215 | 5991 |
| RSV770 | Nanobody binding to RSV F protein | LG2074D | US20110182897 SEQ ID NO: 216 | 5992 |
| RSV771 | Nanobody binding to RSV F protein | LG2074H | US20110182897 SEQ ID NO: 217 | 5993 |
| RSV772 | Nanobody binding to RSV F protein | LG2075A | US20110182897 SEQ ID NO: 218 | 5994 |
| RSV773 | Nanobody binding to RSV F protein | LG2075B | US20110182897 SEQ ID NO: 219 | 5995 |
| RSV774 | Nanobody binding to RSV F protein | LG2075C | US20110182897 SEQ ID NO: 220 | 5996 |
| RSV775 | Nanobody binding to RSV F protein | LG2075D | US20110182897 SEQ ID NO: 221 | 5997 |
| RSV776 | Nanobody binding to RSV F protein | LG2075E | US20110182897 SEQ ID NO: 222 | 5998 |
| RSV777 | Nanobody binding to RSV F protein | LG2076A | US20110182897 SEQ ID NO: 223 | 5999 |
| RSV778 | Nanobody binding to RSV F protein | LG2076B | US20110182897 SEQ ID NO: 224 | 6000 |
| RSV779 | Nanobody binding to RSV F protein | LG2076C | US20110182897 SEQ ID NO: 225 | 6001 |
| RSV780 | Nanobody binding to RSV F protein | LG2076D | US20110182897 SEQ ID NO: 226 | 6002 |
| RSV781 | Nanobody binding to RSV F protein | LG2076E | US20110182897 SEQ ID NO: 227 | 6003 |
| RSV782 | Nanobody binding to RSV F protein | LG2076F | US20110182897 SEQ ID NO: 228 | 6004 |

TABLE 22-continued

Antibodies against Respiratory Syncytial Virus

| Antibody No. | Description | Antibody Name | Reference Information | SEQ ID NO |
|---|---|---|---|---|
| RSV783 | Nanobody binding to RSV F protein | LG2079A | US20110182897 SEQ ID NO: 229 | 6005 |
| RSV784 | Nanobody binding to RSV F protein | LG2079B | US20110182897 SEQ ID NO: 230 | 6006 |
| RSV785 | Nanobody binding to RSV F protein | LG2079C | US20110182897 SEQ ID NO: 231 | 6007 |
| RSV786 | Nanobody binding to RSV F protein | LG2079D | US20110182897 SEQ ID NO: 232 | 6008 |
| RSV787 | Nanobody binding to RSV F protein | LG2079E | US20110182897 SEQ ID NO: 233 | 6009 |
| RSV788 | Nanobody binding to RSV F protein | LG2079F | US20110182897 SEQ ID NO: 234 | 6010 |
| RSV789 | Nanobody binding to RSV F protein | LG2079G | US20110182897 SEQ ID NO: 235 | 6011 |
| RSV790 | Nanobody binding to RSV F protein | LG2079H | US20110182897 SEQ ID NO: 236 | 6012 |
| RSV791 | Nanobody binding to RSV F protein | LG213B7 | US20110182897 SEQ ID NO: 237 | 6013 |
| RSV792 | Nanobody binding to RSV F protein | LG213D6 | US20110182897 SEQ ID NO: 238 | 6014 |
| RSV793 | Nanobody binding to RSV F protein | LG213D7 | US20110182897 SEQ ID NO: 239 | 6015 |
| RSV794 | Nanobody binding to RSV F protein | LG213E6 | US20110182897 SEQ ID NO: 240 | 6016 |
| RSV795 | Nanobody binding to RSV F protein | LG213H7 | US20110182897 SEQ ID NO: 241 | 6017 |
| RSV796 | Nanobody binding to RSV F protein | LG214A8 | US20110182897 SEQ ID NO: 242 | 6018 |
| RSV797 | Nanobody binding to RSV F protein | LG214C10 | US20110182897 SEQ ID NO: 243 | 6019 |
| RSV798 | Nanobody binding to RSV F protein | LG214D10 | US20110182897 SEQ ID NO: 244 | 6020 |
| RSV799 | Nanobody binding to RSV F protein | LG214E8 | US20110182897 SEQ ID NO: 245 | 6021 |
| RSV800 | Nanobody binding to RSV F protein | LG214F8 | US20110182897 SEQ ID NO: 246 | 6022 |
| RSV801 | Nanobody binding to RSV F protein | LG214H10 | US20110182897 SEQ ID NO: 247 | 6023 |
| RSV802 | Nanobody binding to RSV F protein | RSVPMP5C1 | US20110182897 SEQ ID NO: 248 | 6024 |
| RSV803 | Nanobody binding to RSV F protein | RSVPMP8A1 | US20110182897 SEQ ID NO: 249 | 6025 |
| RSV804 | Nanobody binding to RSV F protein | RSVPMP8G1 | US20110182897 SEQ ID NO: 250 | 6026 |
| RSV805 | Nanobody binding to RSV F protein | RSVPMP25B3 | US20110182897 SEQ ID NO: 251 | 6027 |
| RSV806 | Nanobody binding to RSV F protein | RSVPMP8C8 | US20110182897 SEQ ID NO: 252 | 6028 |
| RSV807 | Nanobody binding to RSV F protein | RSVPMP5A6 | US20110182897 SEQ ID NO: 253 | 6029 |
| RSV808 | Nanobody binding to RSV F protein | RSVPMP8E11 | US20110182897 SEQ ID NO: 254 | 6030 |
| RSV809 | Nanobody binding to RSV F protein | RSVPMP8F11 | US20110182897 SEQ ID NO: 255 | 6031 |
| RSV810 | Nanobody binding to RSV F protein | RSVPMP13F11 | US20110182897 SEQ ID NO: 256 | 6032 |
| RSV811 | Nanobody binding to RSV F protein | RSVPMP15B8 | US20110182897 SEQ ID NO: 257 | 6033 |
| RSV812 | Nanobody binding to RSV F protein | RSVPMP15G11 | US20110182897 SEQ ID NO: 258 | 6034 |
| RSV813 | Nanobody binding to RSV F protein | RSVPMP17C10 | US20110182897 SEQ ID NO: 259 | 6035 |
| RSV814 | Nanobody binding to RSV F protein | RSVPMP21E7 | US20110182897 SEQ ID NO: 260 | 6036 |
| RSV815 | Nanobody binding to RSV F protein | RSVPMP21F8 | US20110182897 SEQ ID NO: 261 | 6037 |
| RSV816 | Nanobody binding to RSV F protein | RSVPMP5A2 | US20110182897 SEQ ID NO: 262 | 6038 |
| RSV817 | Nanobody binding to RSV F protein | RSVPMP5B2 | US20110182897 SEQ ID NO: 263 | 6039 |
| RSV818 | Nanobody binding to RSV F protein | RSVPMP5C3 | US20110182897 SEQ ID NO: 264 | 6040 |
| RSV819 | Nanobody binding to RSV F protein | RSVPMP5D2 | US20110182897 SEQ ID NO: 265 | 6041 |

TABLE 22-continued

Antibodies against Respiratory Syncytial Virus

| Antibody No. | Description | Antibody Name | Reference Information | SEQ ID NO |
|---|---|---|---|---|
| RSV820 | Nanobody binding to RSV F protein | RSVPMP5E2 | US20110182897 SEQ ID NO: 266 | 6042 |
| RSV821 | Nanobody binding to RSV F protein | RSVPMP5F3 | US20110182897 SEQ ID NO: 267 | 6043 |
| RSV822 | Nanobody binding to RSV F protein | RSVPMP5G3 | US20110182897 SEQ ID NO: 268 | 6044 |
| RSV823 | Nanobody binding to RSV F protein | RSVPMP5H2 | US20110182897 SEQ ID NO: 269 | 6045 |
| RSV824 | Nanobody binding to RSV F protein | RSVPMP5H3 | US20110182897 SEQ ID NO: 270 | 6046 |
| RSV825 | Nanobody binding to RSV F protein | RSVPMP8C1 | US20110182897 SEQ ID NO: 271 | 6047 |
| RSV826 | Nanobody binding to RSV F protein | RSVPMP8F2 | US20110182897 SEQ ID NO: 272 | 6048 |
| RSV827 | Nanobody binding to RSV F protein | RSVPMP8G4 | US20110182897 SEQ ID NO: 273 | 6049 |
| RSV828 | Nanobody binding to RSV F protein | RSVPMP13A1 | US20110182897 SEQ ID NO: 274 | 6050 |
| RSV829 | Nanobody binding to RSV F protein | RSVPMP13A4 | US20110182897 SEQ ID NO: 275 | 6051 |
| RSV830 | Nanobody binding to RSV F protein | RSVPMP13B1 | US20110182897 SEQ ID NO: 276 | 6052 |
| RSV831 | Nanobody binding to RSV F protein | RSVPMP13B2 | US20110182897 SEQ ID NO: 277 | 6053 |
| RSV832 | Nanobody binding to RSV F protein | RSVPMP13C1 | US20110182897 SEQ ID NO: 278 | 6054 |
| RSV833 | Nanobody binding to RSV F protein | RSVPMP13C3 | US20110182897 SEQ ID NO: 279 | 6055 |
| RSV834 | Nanobody binding to RSV F protein | RSVPMP13D6 | US20110182897 SEQ ID NO: 280 | 6056 |
| RSV835 | Nanobody binding to RSV F protein | RSVPMP13E2 | US20110182897 SEQ ID NO: 281 | 6057 |
| RSV836 | Nanobody binding to RSV F protein | RSVPMP13E3 | US20110182897 SEQ ID NO: 282 | 6058 |
| RSV837 | Nanobody binding to RSV F protein | RSVPMP15A5 | US20110182897 SEQ ID NO: 283 | 6059 |
| RSV838 | Nanobody binding to RSV F protein | RSVPMP15A6 | US20110182897 SEQ ID NO: 284 | 6060 |
| RSV839 | Nanobody binding to RSV F protein | RSVPMP15B2 | US20110182897 SEQ ID NO: 285 | 6061 |
| RSV840 | Nanobody binding to RSV F protein | RSVPMP15B3 | US20110182897 SEQ ID NO: 286 | 6062 |
| RSV841 | Nanobody binding to RSV F protein | RSVPMP15E5 | US20110182897 SEQ ID NO: 287 | 6063 |
| RSV842 | Nanobody binding to RSV F protein | RSVPMP17C2 | US20110182897 SEQ ID NO: 288 | 6064 |
| RSV843 | Nanobody binding to RSV F protein | RSVPMP17D4 | US20110182897 SEQ ID NO: 289 | 6065 |
| RSV844 | Nanobody binding to RSV F protein | RSVPMP17G4 | US20110182897 SEQ ID NO: 290 | 6066 |
| RSV845 | Nanobody binding to RSV F protein | RSVPMP19B2 | US20110182897 SEQ ID NO: 291 | 6067 |
| RSV846 | Nanobody binding to RSV F protein | RSVPMP25A4 | US20110182897 SEQ ID NO: 292 | 6068 |
| RSV847 | Nanobody binding to RSV F protein | RSVPMP25A9 | US20110182897 SEQ ID NO: 293 | 6069 |
| RSV848 | Nanobody binding to RSV F protein | RSVPMP25B5 | US20110182897 SEQ ID NO: 294 | 6070 |
| RSV849 | Nanobody binding to RSV F protein | RSVPMP25G2 | US20110182897 SEQ ID NO: 295 | 6071 |
| RSV850 | Nanobody binding to RSV F protein | RSVPMP25H5 | US20110182897 SEQ ID NO: 296 | 6072 |
| RSV851 | Nanobody binding to RSV F protein | RSVPMP25E11 | US20110182897 SEQ ID NO: 297 | 6073 |
| RSV852 | Nanobody binding to RSV F protein | RSVPMP8G3 | US20110182897 SEQ ID NO: 298 | 6074 |
| RSV853 | Nanobody binding to RSV F protein | RSVPMP13B5 | US20110182897 SEQ ID NO: 299 | 6075 |
| RSV854 | Nanobody binding to RSV F protein | RSVPMP15F2 | US20110182897 SEQ ID NO: 300 | 6076 |
| RSV855 | Nanobody binding to RSV F protein | RSVPMP19E2 | US20110182897 SEQ ID NO: 301 | 6077 |
| RSV856 | Nanobody binding to RSV F protein | RSVPMP25D1 | US20110182897 SEQ ID NO: 302 | 6078 |

TABLE 22-continued

Antibodies against Respiratory Syncytial Virus

| Antibody No. | Description | Antibody Name | Reference Information | SEQ ID NO |
|---|---|---|---|---|
| RSV857 | Nanobody binding to RSV F protein | RSVPMP5A1 | US20110182897 SEQ ID NO: 303 | 6079 |
| RSV858 | Nanobody binding to RSV F protein | RSVPMP5G2 | US20110182897 SEQ ID NO: 304 | 6080 |
| RSV859 | Nanobody binding to RSV F protein | RSVPMP5H1 | US20110182897 SEQ ID NO: 305 | 6081 |
| RSV860 | Nanobody binding to RSV F protein | RSVPMP6B1 | US20110182897 SEQ ID NO: 306 | 6082 |
| RSV861 | Nanobody binding to RSV F protein | RSVPMP8H2 | US20110182897 SEQ ID NO: 307 | 6083 |
| RSV862 | Nanobody binding to RSV F protein | RSVPMP8H3 | US20110182897 SEQ ID NO: 308 | 6084 |
| RSV863 | Nanobody binding to RSV F protein | RSVPMP13A3 | US20110182897 SEQ ID NO: 309 | 6085 |
| RSV864 | Nanobody binding to RSV F protein | RSVPMP13C5 | US20110182897 SEQ ID NO: 310 | 6086 |
| RSV865 | Nanobody binding to RSV F protein | RSVPMP13H1 | US20110182897 SEQ ID NO: 311 | 6087 |
| RSV866 | Nanobody binding to RSV F protein | RSVPMP13H2 | US20110182897 SEQ ID NO: 312 | 6088 |
| RSV867 | Nanobody binding to RSV F protein | RSVPMP15E6 | US20110182897 SEQ ID NO: 313 | 6089 |
| RSV868 | Nanobody binding to RSV F protein | RSVPMP17A3 | US20110182897 SEQ ID NO: 314 | 6090 |
| RSV869 | Nanobody binding to RSV F protein | RSVPMP25G8 | US20110182897 SEQ ID NO: 315 | 6091 |
| RSV870 | Nanobody binding to RSV F protein | RSVPMP6D1 | US20110182897 SEQ ID NO: 316 | 6092 |
| RSV871 | Nanobody binding to RSV F protein | RSVPMP8D5 | US20110182897 SEQ ID NO: 317 | 6093 |
| RSV872 | Nanobody binding to RSV F protein | RSVPMP13B4 | US20110182897 SEQ ID NO: 318 | 6094 |
| RSV873 | Nanobody binding to RSV F protein | RSVPMP13B6 | US20110182897 SEQ ID NO: 319 | 6095 |
| RSV874 | Nanobody binding to RSV F protein | RSVPMP13E6 | US20110182897 SEQ ID NO: 320 | 6096 |
| RSV875 | Nanobody binding to RSV F protein | RSVPMP13F4 | US20110182897 SEQ ID NO: 321 | 6097 |
| RSV876 | Nanobody binding to RSV F protein | RSVPMP15H3 | US20110182897 SEQ ID NO: 322 | 6098 |
| RSV877 | Nanobody binding to RSV F protein | RSVPMP17E5 | US20110182897 SEQ ID NO: 323 | 6099 |
| RSV878 | Nanobody binding to RSV F protein | RSVPMP19D3 | US20110182897 SEQ ID NO: 324 | 6100 |
| RSV879 | Nanobody binding to RSV F protein | RSVPMP19F3 | US20110182897 SEQ ID NO: 325 | 6101 |
| RSV880 | Nanobody binding to RSV F protein | RSVPMP25C4 | US20110182897 SEQ ID NO: 326 | 6102 |
| RSV881 | Nanobody binding to RSV F protein | RSVPMP25E3 | US20110182897 SEQ ID NO: 327 | 6103 |
| RSV882 | Nanobody binding to RSV F protein | RSVPMP5G4 | US20110182897 SEQ ID NO: 328 | 6104 |
| RSV883 | Nanobody binding to RSV F protein | RSVPMP6G5 | US20110182897 SEQ ID NO: 329 | 6105 |
| RSV884 | Nanobody binding to RSV F protein | RSVPMP8E6 | US20110182897 SEQ ID NO: 330 | 6106 |
| RSV885 | Nanobody binding to RSV F protein | RSVPMP13A10 | US20110182897 SEQ ID NO: 331 | 6107 |
| RSV886 | Nanobody binding to RSV F protein | RSVPMP21H10 | US20110182897 SEQ ID NO: 332 | 6108 |
| RSV887 | Nanobody binding to RSV F protein | RSVPMP5A8 | US20110182897 SEQ ID NO: 333 | 6109 |
| RSV888 | Nanobody binding to RSV F protein | RSVPMP5A10 | US20110182897 SEQ ID NO: 334 | 6110 |
| RSV889 | Nanobody binding to RSV F protein | RSVPMPHA6 | US20110182897 SEQ ID NO: 335 | 6111 |
| RSV890 | Nanobody binding to RSV F protein | RSVPMP16A6 | US20110182897 SEQ ID NO: 336 | 6112 |
| RSV891 | Nanobody binding to RSV F protein | RSVPMP22D6 | US20110182897 SEQ ID NO: 337 | 6113 |
| RSV892 | Nanobody binding to RSV F protein | RSVPMP8E2 | US20110182897 SEQ ID NO: 338 | 6114 |
| RSV893 | Nanobody binding to RSV F protein | RSVPMP8C6 | US20110182897 SEQ ID NO: 339 | 6115 |

TABLE 22-continued

Antibodies against Respiratory Syncytial Virus

| Antibody No. | Description | Antibody Name | Reference Information | SEQ ID NO |
|---|---|---|---|---|
| RSV894 | Nanobody binding to RSV F protein | RSVPMP5C6 | US20110182897 SEQ ID NO: 340 | 6116 |
| RSV895 | Nanobody binding to RSV F protein | RSVPMP6D4 | US20110182897 SEQ ID NO: 341 | 6117 |
| RSV896 | Nanobody binding to RSV F protein | RSVPMP8B10 | US20110182897 SEQ ID NO: 342 | 6118 |
| RSV897 | Nanobody binding to RSV F protein | RSVPMP8E10 | US20110182897 SEQ ID NO: 343 | 6119 |
| RSV898 | Nanobody binding to RSV F protein | RSVPMP15A7 | US20110182897 SEQ ID NO: 344 | 6120 |
| RSV899 | Nanobody binding to RSV F protein | RSVPMP15E10 | US20110182897 SEQ ID NO: 345 | 6121 |
| RSV900 | Nanobody binding to RSV F protein | RSVPMP13C7 | US20110182897 SEQ ID NO: 346 | 6122 |
| RSV901 | Nanobody binding to RSV F protein | RSVPMP15A9 | US20110182897 SEQ ID NO: 347 | 6123 |
| RSV902 | Nanobody binding to RSV F protein | RSVPMP15F11 | US20110182897 SEQ ID NO: 348 | 6124 |
| RSV903 | Nanobody binding to RSV F protein | RSVPMP15A1 | US20110182897 SEQ ID NO: 349 | 6125 |
| RSV904 | Nanobody binding to RSV F protein | RSVPMP6H2 | US20110182897 SEQ ID NO: 350 | 6126 |
| RSV905 | Nanobody binding to RSV F protein | RSVPMP17A9 | US20110182897 SEQ ID NO: 351 | 6127 |
| RSV906 | Nanobody binding to RSV F protein | RSVPMP7G1 | US20110182897 SEQ ID NO: 352 | 6128 |
| RSV907 | Nanobody binding to RSV F protein | RSVPMP5A9 | US20110182897 SEQ ID NO: 353 | 6129 |
| RSV908 | Nanobody binding to RSV F protein | RSVPMP7B2 | US20110182897 SEQ ID NO: 354 | 6130 |
| RSV909 | Nanobody binding to RSV F protein | RSVPMP22A4 | US20110182897 SEQ ID NO: 355 | 6131 |
| RSV910 | Nanobody binding to RSV F protein | RSVPMP22E10 | US20110182897 SEQ ID NO: 356 | 6132 |
| RSV911 | Nanobody binding to RSV F protein | RSVPMP22H4 | US20110182897 SEQ ID NO: 357 | 6133 |
| RSV912 | Nanobody binding to RSV F protein | RSVPMP15C5 | US20110182897 SEQ ID NO: 358 | 6134 |
| RSV913 | Nanobody binding to RSV F protein | RSVNC39 | US20110182897 SEQ ID NO: 359 | 6135 |
| RSV914 | Nanobody binding to RSV F protein | RSVPMP7B9 | US20110182897 SEQ ID NO: 360 | 6136 |
| RSV915 | Nanobody binding to RSV F protein | RSVPMP15E11 | US20110182897 SEQ ID NO: 361 | 6137 |
| RSV916 | Nanobody binding to RSV F protein | RSVPMP7E7 | US20110182897 SEQ ID NO: 362 | 6138 |
| RSV917 | Nanobody binding to RSV F protein | RSVPMP14H3 | US20110182897 SEQ ID NO: 363 | 6139 |
| RSV918 | Nanobody binding to RSV F protein | RSVPMP24D6 | US20110182897 SEQ ID NO: 364 | 6140 |
| RSV919 | Nanobody binding to RSV F protein | RSVPMP23E5 | US20110182897 SEQ ID NO: 365 | 6141 |
| RSV920 | Nanobody binding to RSV F protein | RSVPMP8A6 | US20110182897 SEQ ID NO: 366 | 6142 |
| RSV921 | Nanobody binding to RSV F protein | RSVPMP14E2 | US20110182897 SEQ ID NO: 367 | 6143 |
| RSV922 | Nanobody binding to RSV F protein | RSVPMP25F3 | US20110182897 SEQ ID NO: 368 | 6144 |
| RSV923 | Nanobody binding to RSV F protein | RSVPMP19A6 | US20110182897 SEQ ID NO: 369 | 6145 |
| RSV924 | Nanobody binding to RSV F protein | RSVPMP23G1 | US20110182897 SEQ ID NO: 370 | 6146 |
| RSV925 | Nanobody binding to RSV F protein | RSVPMP15H8 | US20110182897 SEQ ID NO: 371 | 6147 |
| RSV926 | Nanobody binding to RSV F protein | RSVNC41 | US20110182897 SEQ ID NO: 372 | 6148 |
| RSV927 | Nanobody binding to RSV F protein | RSVPMP6A8 | US20110182897 SEQ ID NO: 373 | 6149 |
| RSV928 | Nanobody binding to RSV F protein | RSVPMP25H9 | US20110182897 SEQ ID NO: 374 | 6150 |
| RSV929 | Nanobody binding to RSV F protein | RSVPMP8B11 | US20110182897 SEQ ID NO: 375 | 6151 |
| RSV930 | Nanobody binding to RSV F protein | RSVPMP17E1 | US20110182897 SEQ ID NO: 376 | 6152 |

TABLE 22-continued

Antibodies against Respiratory Syncytial Virus

| Antibody No. | Description | Antibody Name | Reference Information | SEQ ID NO |
|---|---|---|---|---|
| RSV931 | Nanobody binding to RSV F protein | RSVPMP21A4 | US20110182897 SEQ ID NO: 377 | 6153 |
| RSV932 | Nanobody binding to RSV F protein | RSVPMP25A11 | US20110182897 SEQ ID NO: 378 | 6154 |
| RSV933 | Nanobody binding to RSV F protein | RSVPMP25C8 | US20110182897 SEQ ID NO: 379 | 6155 |
| RSV934 | Nanobody binding to RSV F protein | RSVNC23 | US20110182897 SEQ ID NO: 380 | 6156 |
| RSV935 | Nanobody binding to RSV F protein | RSVPMP20A11 | US20110182897 SEQ ID NO: 381 | 6157 |
| RSV936 | Nanobody binding to RSV F protein | RSVPMP20A9 | US20110182897 SEQ ID NO: 382 | 6158 |
| RSV937 | Nanobody binding to RSV F protein | RSVPMP1F7 | US20110182897 SEQ ID NO: 383 | 6159 |
| RSV938 | Nanobody binding to RSV F protein | RSVPMP20D6 | US20110182897 SEQ ID NO: 384 | 6160 |
| RSV939 | Nanobody binding to RSV F protein | RSVPMP1F1 | US20110182897 SEQ ID NO: 385 | 6161 |
| RSV940 | Nanobody binding to RSV F protein | RSVPMP3D3 | US20110182897 SEQ ID NO: 386 | 6162 |
| RSV941 | Nanobody binding to RSV F protein | RSVPMP3E6 | US20110182897 SEQ ID NO: 387 | 6163 |
| RSV942 | Nanobody binding to RSV F protein | RSVPMP1C8 | US20110182897 SEQ ID NO: 388 | 6164 |
| RSV943 | Nanobody binding to RSV F protein | RSVPMP1A2 | US20110182897 SEQ ID NO: 389 | 6165 |
| RSV944 | Nanobody binding to RSV F protein | RSVPMP1C5 | US20110182897 SEQ ID NO: 390 | 6166 |
| RSV945 | Nanobody binding to RSV F protein | RSVPMP20G5 | US20110182897 SEQ ID NO: 391 | 6167 |
| RSV946 | Nanobody binding to RSV F protein | RSVPMP4D8 | US20110182897 SEQ ID NO: 392 | 6168 |
| RSV947 | Nanobody binding to RSV F protein | RSVPMP20B6 | US20110182897 SEQ ID NO: 393 | 6169 |
| RSV948 | Nanobody binding to RSV F protein | RSVPMP1D11 | US20110182897 SEQ ID NO: 394 | 6170 |
| RSV949 | Nanobody binding to RSV F protein | RSVPMP20A8 | US20110182897 SEQ ID NO: 395 | 6171 |
| RSV950 | Nanobody binding to RSV F protein | RSVPMP20E7 | US20110182897 SEQ ID NO: 396 | 6172 |
| RSV951 | Nanobody binding to RSV F protein | RSVPMP20G8 | US20110182897 SEQ ID NO: 397 | 6173 |
| RSV952 | Nanobody binding to RSV F protein | RSVPMP2D3 | US20110182897 SEQ ID NO: 398 | 6174 |
| RSV953 | Nanobody binding to RSV F protein | RSVPMP2G5 | US20110182897 SEQ ID NO: 399 | 6175 |
| RSV954 | Nanobody binding to RSV F protein | RSVPMP2A6 | US20110182897 SEQ ID NO: 400 | 6176 |
| RSV955 | Nanobody binding to RSV F protein | RSVPMP3A2 | US20110182897 SEQ ID NO: 401 | 6177 |
| RSV956 | Nanobody binding to RSV F protein | RSVPMP4A8 | US20110182897 SEQ ID NO: 402 | 6178 |
| RSV957 | Nanobody binding to RSV F protein | RSVPMP4F9 | US20110182897 SEQ ID NO: 403 | 6179 |
| RSV958 | Nanobody binding to RSV F protein | RSVPMP1A6 | US20110182897 SEQ ID NO: 404 | 6180 |
| RSV959 | Nanobody binding to RSV F protein | RSVPMP3C2 | US20110182897 SEQ ID NO: 405 | 6181 |
| RSV960 | Nanobody binding to RSV F protein | RSVPMP4H9 | US20110182897 SEQ ID NO: 406 | 6182 |
| RSV961 | Nanobody binding to RSV F protein | RSVPMP4B10 | US20110182897 SEQ ID NO: 407 | 6183 |
| RSV962 | Nanobody binding to RSV F protein | 203B1 | US20110182897 SEQ ID NO: 2431 | 6184 |
| RSV963 | Nanobody binding to RSV F protein | 203B2 | US20110182897 SEQ ID NO: 2432 | 6185 |
| RSV964 | Nanobody binding to RSV F protein | 203G1 | US20110182897 SEQ ID NO: 2433 | 6186 |
| RSV965 | Nanobody binding to RSV F protein | 203H1 | US20110182897 SEQ ID NO: 2434 | 6187 |
| RSV966 | Nanobody binding to RSV F protein | 202E4 | US20110182897 SEQ ID NO: 2435 | 6188 |
| RSV967 | Nanobody binding to RSV F protein | 189E2 | US20110182897 SEQ ID NO: 2436 | 6189 |

TABLE 22-continued

Antibodies against Respiratory Syncytial Virus

| Antibody No. | Description | Antibody Name | Reference Information | SEQ ID NO |
|---|---|---|---|---|
| RSV968 | Nanobody binding to RSV F protein | 203A12 | US20110182897 SEQ ID NO: 2437 | 6190 |
| RSV969 | Nanobody binding to RSV F protein | 203A9 | US20110182897 SEQ ID NO: 2438 | 6191 |
| RSV970 | Nanobody binding to RSV F protein | 203B12 | US20110182897 SEQ ID NO: 2439 | 6192 |
| RSV971 | Nanobody binding to RSV F protein | 203D2 | US20110182897 SEQ ID NO: 2440 | 6193 |
| RSV972 | Nanobody binding to RSV F protein | 203D9 | US20110182897 SEQ ID NO: 2441 | 6194 |
| RSV973 | Nanobody binding to RSV F protein | 203G3 | US20110182897 SEQ ID NO: 2442 | 6195 |
| RSV974 | Nanobody binding to RSV F protein | 203G9 | US20110182897 SEQ ID NO: 2443 | 6196 |
| RSV975 | Nanobody binding to RSV F protein | 203G10 | US20110182897 SEQ ID NO: 2444 | 6197 |
| RSV976 | Nanobody binding to RSV F protein | 203H9 | US20110182897 SEQ ID NO: 2445 | 6198 |
| RSV977 | Nanobody binding to RSV F protein | 203H10 | US20110182897 SEQ ID NO: 2446 | 6199 |
| RSV978 | Nanobody binding to RSV F protein | 202E4 | US20110182897 SEQ ID NO: 2447 | 6200 |
| RSV979 | Nanobody binding to RSV F protein | 189E2 | US20110182897 SEQ ID NO: 2448 | 6201 |
| RSV980 | Nanobody binding to RSV F protein | PRSVPMP20C3 | US20110182897 SEQ ID NO: 2574 | 6202 |
| RSV981 | Nanobody binding to RSV F protein | PRSVPMP20C5 | US20110182897 SEQ ID NO: 2575 | 6203 |
| RSV982 | Nanobody binding to RSV F protein | PRSVPMP20B2 | US20110182897 SEQ ID NO: 2576 | 6204 |
| RSV983 | Nanobody binding to RSV F protein | PRSVPMP20C1 | US20110182897 SEQ ID NO: 2577 | 6205 |
| RSV984 | Nanobody binding to RSV F protein | PRSVPMP1G8 | US20110182897 SEQ ID NO: 2578 | 6206 |
| RSV985 | Nanobody binding to RSV F protein | PRSVNMP1A4 | US20110182897 SEQ ID NO: 2579 | 6207 |
| RSV986 | Nanobody binding to RSV F protein | PRSVPMP13E12 | US20110182897 SEQ ID NO: 2580 | 6208 |
| RSV987 | Nanobody binding to RSV F protein | PRSVPMP5C6 | US20110182897 SEQ ID NO: 2581 | 6209 |
| RSV988 | Nanobody binding to RSV F protein | LG203E7 | US20110182897 SEQ ID NO: 2682 | 6210 |
| RSV989 | Nanobody binding to RSV F protein | LG203G8 | US20110182897 SEQ ID NO: 2683 | 6211 |
| RSV990 | Nanobody binding to RSV F protein | LG211A10 | US20110182897 SEQ ID NO: 2684 | 6212 |
| RSV991 | Nanobody binding to RSV F protein | LG211A8 | US20110182897 SEQ ID NO: 2685 | 6213 |
| RSV992 | Nanobody binding to RSV F protein | LG211B10 | US20110182897 SEQ ID NO: 2686 | 6214 |
| RSV993 | Nanobody binding to RSV F protein | LG211B8 | US20110182897 SEQ ID NO: 2687 | 6215 |
| RSV994 | Nanobody binding to RSV F protein | LG211C12 | US20110182897 SEQ ID NO: 2688 | 6216 |
| RSV995 | Nanobody binding to RSV F protein | LG211C8 | US20110182897 SEQ ID NO: 2689 | 6217 |
| RSV996 | Nanobody binding to RSV F protein | LG211D10 | US20110182897 SEQ ID NO: 2690 | 6218 |
| RSV997 | Nanobody binding to RSV F protein | LG211D8 | US20110182897 SEQ ID NO: 2691 | 6219 |
| RSV998 | Nanobody binding to RSV F protein | LG211E10 | US20110182897 SEQ ID NO: 2692 | 6220 |
| RSV999 | Nanobody binding to RSV F protein | LG211E12 | US20110182897 SEQ ID NO: 2693 | 6221 |
| RSV1000 | Nanobody binding to RSV F protein | LG211E8 | US20110182897 SEQ ID NO: 2694 | 6222 |
| RSV1001 | Nanobody binding to RSV F protein | LG211H8 | US20110182897 SEQ ID NO: 2695 | 6223 |
| RSV1002 | Nanobody binding to RSV F protein | LG212A10 | US20110182897 SEQ ID NO: 2696 | 6224 |
| RSV1003 | Nanobody binding to RSV F protein | LG212A12 | US20110182897 SEQ ID NO: 2697 | 6225 |
| RSV1004 | Nanobody binding to RSV F protein | LG212A2 | US20110182897 SEQ ID NO: 2698 | 6226 |

TABLE 22-continued

Antibodies against Respiratory Syncytial Virus

| Antibody No. | Description | Antibody Name | Reference Information | SEQ ID NO |
|---|---|---|---|---|
| RSV1005 | Nanobody binding to RSV F protein | LG212A8 | US20110182897 SEQ ID NO: 2699 | 6227 |
| RSV1006 | Nanobody binding to RSV F protein | LG212B12 | US20110182897 SEQ ID NO: 2700 | 6228 |
| RSV1007 | Nanobody binding to RSV F protein | LG212B2 | US20110182897 SEQ ID NO: 2701 | 6229 |
| RSV1008 | Nanobody binding to RSV F protein | LG212C12 | US20110182897 SEQ ID NO: 2702 | 6230 |
| RSV1009 | Nanobody binding to RSV F protein | LG212D10 | US20110182897 SEQ ID NO: 2703 | 6231 |
| RSV1010 | Nanobody binding to RSV F protein | LG212D12 | US20110182897 SEQ ID NO: 2704 | 6232 |
| RSV1011 | Nanobody binding to RSV F protein | L0212D2 | US20110182897 SEQ ID NO: 2705 | 6233 |
| RSV1012 | Nanobody binding to RSV F protein | LG212E10 | US20110182897 SEQ ID NO: 2706 | 6234 |
| RSV1013 | Nanobody binding to RSV F protein | LG212E12 | US20110182897 SEQ ID NO: 2707 | 6235 |
| RSV1014 | Nanobody binding to RSV F protein | LG212E6 | US20110182897 SEQ ID NO: 2708 | 6236 |
| RSV1015 | Nanobody binding to RSV F protein | LG212F10 | US20110182897 SEQ ID NO: 2709 | 6237 |
| RSV1016 | Nanobody binding to RSV F protein | LG212F12 | US20110182897 SEQ ID NO: 2710 | 6238 |
| RSV1017 | Nanobody binding to RSV F protein | LG212F6 | US20110182897 SEQ ID NO: 2711 | 6239 |
| RSV1018 | Nanobody binding to RSV F protein | LG212F8 | US20110182897 SEQ ID NO: 2712 | 6240 |
| RSV1019 | Nanobody binding to RSV F protein | LG212G10 | US20110182897 SEQ ID NO: 2713 | 6241 |
| RSV1020 | Nanobody binding to RSV F protein | LG212G2 | US20110182897 SEQ ID NO: 2714 | 6242 |
| RSV1021 | Nanobody binding to RSV F protein | LG212H10 | US20110182897 SEQ ID NO: 2715 | 6243 |
| RSV1022 | Nanobody binding to RSV F protein | LG212H2 | US20110182897 SEQ ID NO: 2716 | 6244 |
| RSVI023 | Nanobody binding to RSV F protein | LG212H8 | US20110182897 SEQ ID NO: 2717 | 6245 |
| RSV1024 | Nanobody binding to RSV F protein | IV121 | US20110182897 SEQ ID NO: 3064 | 6246 |
| RSV1025 | Nanobody binding to RSV F protein | IV122 | US20110182897 SEQ ID NO: 3065 | 6247 |
| RSV1026 | Nanobody binding to RSV F protein | IV123 | US20110182897 SEQ ID NO: 3066 | 6248 |
| RSV1027 | Nanobody binding to RSV F protein | IV126 | US20110182897 SEQ ID NO: 3067 | 6249 |
| RSV1028 | Nanobody binding to RSV F protein | IV127 | US20110182897 SEQ ID NO: 3068 | 6250 |
| RSV1029 | Nanobody binding to RSV F protein | IV131 | US20110182897 SEQ ID NO: 3069 | 6251 |
| RSV1030 | Nanobody binding to RSV F protein | IV132 | US20110182897 SEQ ID NO: 3070 | 6252 |
| RSV1031 | Nanobody binding to RSV F protein | IV133 | US20110182897 SEQ ID NO: 3071 | 6253 |
| RSV1032 | Nanobody binding to RSV F protein | IV134 | US20110182897 SEQ ID NO: 3072 | 6254 |
| RSV1033 | Nanobody binding to RSV F protein | IV135 | US20110182897 SEQ ID NO: 3073 | 6255 |
| RSV1034 | Nanobody binding to RSV F protein | IV136 | US20110182897 SEQ ID NO: 3074 | 6256 |
| RSV1035 | Nanobody binding to RSV F protein | IV140 | US20110182897 SEQ ID NO: 3075 | 6257 |
| RSV1036 | Nanobody binding to RSV F protein | IV144 | US20110182897 SEQ ID NO: 3076 | 6258 |
| RSV1037 | Nanobody binding to RSV F protein | IV156 | US20110182897 SEQ ID NO: 3077 | 6259 |
| RSV1038 | Nanobody binding to RSV F protein | IV157 | US20110182897 SEQ ID NO: 3078 | 6260 |
| RSV1039 | Nanobody binding to RSV F protein | IV160 | US20110182897 SEQ ID NO: 3079 | 6261 |
| RSV1040 | Nanobody binding to RSV F protein | IV124 | US20110182897 SEQ ID NO: 3080 | 6262 |
| RSV1041 | Nanobody binding to RSV F protein | IV125 | US20110182897 SEQ ID NO: 3081 | 6263 |

TABLE 22-continued

Antibodies against Respiratory Syncytial Virus

| Antibody No. | Description | Antibody Name | Reference Information | SEQ ID NO |
|---|---|---|---|---|
| RSV1042 | Nanobody binding to RSV F protein | IV145 | US20110182897 SEQ ID NO: 3082 | 6264 |
| RSV1043 | Nanobody binding to RSV F protein | IV146 | US20110182897 SEQ ID NO: 3083 | 6265 |
| RSV1044 | Nanobody binding to RSV F protein | IV147 | US20110182897 SEQ ID NO: 3084 | 6266 |
| RSV1045 | Nanobody binding to RSV F protein | IV151 | US20110182897 SEQ ID NO: 3085 | 6267 |
| RSV1046 | Nanobody binding to RSV F protein | IV153 | US20110182897 SEQ ID NO: 3086 | 6268 |
| RSV1047 | Nanobody binding to RSV F protein | IV154 | US20110182897 SEQ ID NO: 3087 | 6269 |
| RSV1048 | Nanobody binding to RSV F protein | IV155 | US20110182897 SEQ ID NO: 3088 | 6270 |
| RSV1049 | Nanobody binding to RSV F protein | IV1 | US20110182897 SEQ ID NO: 3089 | 6271 |
| RSV1050 | Nanobody binding to RSV F protein | IV2 | US20110182897 SEQ ID NO: 3090 | 6272 |
| RSV1051 | Nanobody binding to RSV F protein | IV3 | US20110182897 SEQ ID NO: 3091 | 6273 |
| RSV1052 | Nanobody binding to RSV F protein | IV4 | US20110182897 SEQ ID NO: 3092 | 6274 |
| RSV1053 | Nanobody binding to RSV F protein | IV6 | US20110182897 SEQ ID NO: 3093 | 6275 |
| RSV1054 | Nanobody binding to RSV F protein | IV7 | US20110182897 SEQ ID NO: 3094 | 6276 |
| RSV1055 | Nanobody binding to RSV F protein | IV9 | US20110182897 SEQ ID NO: 3095 | 6277 |
| RSV1056 | Nanobody binding to RSV F protein | IV10 | US20110182897 SEQ ID NO: 3096 | 6278 |
| RSV1057 | Nanobody binding to RSV F protein | IV11 | US20110182897 SEQ ID NO: 3097 | 6279 |
| RSV1058 | Nanobody binding to RSV F protein | IV12 | US20110182897 SEQ ID NO: 3098 | 6280 |
| RSV1059 | Nanobody binding to RSV F protein | IV16 | US20110182897 SEQ ID NO: 3099 | 6281 |
| RSV1060 | Nanobody binding to RSV F protein | IV24 | US20110182897 SEQ ID NO: 3100 | 6282 |
| RSV1061 | Nanobody binding to RSV F protein | IV26 | US20110182897 SEQ ID NO: 3101 | 6283 |
| RSV1062 | Nanobody binding to RSV F protein | IV30 | US20110182897 SEQ ID NO: 3102 | 6284 |
| RSV1063 | Nanobody binding to RSV F protein | IV34 | US20110182897 SEQ ID NO: 3103 | 6285 |
| RSV1064 | Nanobody binding to RSV F protein | IV14 | US20110182897 SEQ ID NO: 3104 | 6286 |
| RSV1065 | Nanobody binding to RSV F protein | IV15 | US20110182897 SEQ ID NO: 3105 | 6287 |
| RSV1066 | Nanobody binding to RSV F protein | IV17 | US20110182897 SEQ ID NO: 3106 | 6288 |
| RSV1067 | Nanobody binding to RSV F protein | IV18 | US20110182897 SEQ ID NO: 3107 | 6289 |
| RSV1068 | Nanobody binding to RSV F protein | IV29 | US20110182897 SEQ ID NO: 3108 | 6290 |
| RSV1069 | Nanobody binding to RSV F protein | IV31 | US20110182897 SEQ ID NO: 3109 | 6291 |
| RSV1070 | Nanobody binding to RSV F protein | IV33 | US20110182897 SEQ ID NO: 3110 | 6292 |
| RSV1071 | Nanobody binding to RSV F protein | IV35 | US20110182897 SEQ ID NO: 3111 | 6293 |
| RSV1072 | Nanobody binding to RSV F protein | IV36 | US20110182897 SEQ ID NO: 3112 | 6294 |
| RSV1073 | Nanobody binding to RSV F protein | IV40 | US20110182897 SEQ ID NO: 3113 | 6295 |
| RSV1074 | Nanobody binding to RSV F protein | IV42 | US20110182897 SEQ ID NO: 3114 | 6296 |
| RSV1075 | Nanobody binding to RSV F protein | IV8 | US20110182897 SEQ ID NO: 3115 | 6297 |
| RSV1076 | Nanobody binding to RSV F protein | IV21 | US20110182897 SEQ ID NO: 3116 | 6298 |
| RSV1077 | Nanobody binding to RSV F protein | IV23 | US20110182897 SEQ ID NO: 3117 | 6299 |
| RSV1078 | Nanobody binding to RSV F protein | IV45 | US20110182897 SEQ ID NO: 3118 | 6300 |
| RSV1079 | Nanobody binding to RSV F protein | IV47 | US20110182897 SEQ ID NO: 3119 | 6301 |

TABLE 22-continued

Antibodies against Respiratory Syncytial Virus

| Antibody No. | Description | Antibody Name | Reference Information | SEQ ID NO |
|---|---|---|---|---|
| RSV1080 | Nanobody binding to RSV F protein | IV48 | US20110182897 SEQ ID NO: 3120 | 6302 |
| RSV1081 | Nanobody binding to RSV F protein | IV50 | US20110182897 SEQ ID NO: 3121 | 6303 |
| RSV1082 | Nanobody binding to RSV F protein | IV22 | US20110182897 SEQ ID NO: 3122 | 6304 |
| RSV1083 | Nanobody binding to RSV F protein | IV37 | US20110182897 SEQ ID NO: 3123 | 6305 |
| RSV1084 | Nanobody binding to RSV F protein | IV38 | US20110182897 SEQ ID NO: 3124 | 6306 |
| RSV1085 | Nanobody binding to RSV F protein | IV5 | US20110182897 SEQ ID NO: 3125 | 6307 |
| RSV1086 | Nanobody binding to RSV F protein | IV27 | US20110182897 SEQ ID NO: 3126 | 6308 |
| RSV1087 | Nanobody binding to RSV F protein | IV25 | US20110182897 SEQ ID NO: 3127 | 6309 |
| RSV1088 | Nanobody binding to RSV F protein | IV28 | US20110182897 SEQ ID NO: 3128 | 6310 |

In one embodiment, the payload region of the AAV particle comprises one or more nucleic acid sequences, fragment or variants thereof or encodes one or more polypeptides, fragments or variants thereof described in US Publication No. US20140363427, and International Publication No. WO2004083373, the contents of each of which are herein incorporated by reference in their entirety, against RSV F or RSV G protein.

In one embodiment, the payload region of the AAV particle comprises one or more nucleic acid sequences encoding one or more of the payload antibody polypeptides listed in Table 23 against Hepatitis B, Hepatitis C and/or Hepatitis D.

TABLE 23

Antibodies against Hepatitis B, C, D viruses

| Antibody No. | Description | Antibody Name | Reference Information | SEQ ID NO |
|---|---|---|---|---|
| HEPBD1 | Anti-preS1 immunoglobulin, HBV Ab | | Park, S.G., et al., Hepatitis B virus-neutralizing anti-pre-S1 human antibody fragments from large naive antibody phage library; Antiviral Res. 68 (3), 109-115 (2005); NCBI Accession # AAW82034.1 (107aa) | 6311 |
| HEPBD2 | Anti-preS1 immunoglobulin, HBV Ab | | Park, S.G., et al., Hepatitis B virus-neutralizing anti-pre-S1 human antibody fragments from large naive antibody phage library; Antiviral Res. 68 (3), 109-115 (2005); NCBI Accession # AAW82035.1 (132aa) | 6312 |
| HEPBD3 | Anti-preS1 immunoglobulin, HBV Ab | | Park, S.G., et al., Hepatitis B virus-neutralizing anti-pre-S1 human antibody fragments from large naive antibody phage library; Antiviral Res. 68(3), 109-115 (2005); NCBI Accession # AAW82033.1(111aa) | 6313 |
| HEPBD4 | Anti-preS1 immunoglobulin, HBV Ab | | Park, S.G., et al., Hepatitis B virus-neutralizing anti-pre-S1 human antibody fragments from large naive antibody phage library; Antiviral Res. 68(3), 109-115 (2005); NCBI Accession # AAW82032.1 (142aa) | 6314 |
| HEPBD5 | HCV Ab | Hu5b3.v3 | Pantua, H., et al., Glycan shifting on hepatitis C virus(HCV) e2 glycoprotein is a mechanism for escape from broadly | 6315 |

TABLE 23-continued

Antibodies against Hepatitis B, C, D viruses

| Antibody No. | Description | Antibody Name | Reference Information | SEQ ID NO |
|---|---|---|---|---|
| | | | neutralizing antibodies; J. Mol. Biol. 425 (11), 1899-1914 (2013) NCBI Accession # 4HS8_H(228aa) | |
| HEPBD6 | HCV Ab | Igh526 | Kong L., et al., Structure of Hepatitis C Virus Envelope Glycoprotein E1 Antigenic Site 314-324 in Complex with Antibody IGH526; J. Mol. Biol. 427 (16), 2617-2628 (2015) NCBI Accession # 4N0Y_H(231aa) | 6316 |
| HEPBD7 | Heavy chain partial, HCV Ab | | Esposito, G., et al., Recombinant human antibodies specific for hepatitis C virus proteins; Arch. Virol. 142 (3), 601-610 (1997) NCBI Accession # CAA54914 (122aa) | 6317 |
| HEPBD8 | Heavy chain variable gene, Chimeric HBV Ab | | EP0521348 | 6318 |
| HEPBD9 | Heavy chain variable region partial, HCV Ab | | Keck, Z.Y., et al., Human monoclonal antibody to hepatitis C virUSE1 glycoprotein that blocks virus attachment and viral infectivity; J. Virol. 78 (13), 7257-7263 (2004) NCBI Accession # AAS47839 (142aa) | 6319 |
| HEPBD10 | Heavy chain variable region, HBV Ab | E183/A2 | US20120308580 SEQ ID NO: 33; WO 2011062562; CN102781961, EP2501723 | 6320 |
| HEPBD11 | Heavy chain variable region, HBV Ab | | US20100260712 SEQ ID NO: 1; WO2009069917 | 6321 |
| HEPBD12 | Heavy chain variable region, HBV Ab | | WO2015107126 SEQ ID NO: 2 | 6322 |
| HEPBD13 | Heavy chain variable region, HBV Ab | HB48-33, HB48-35, HB48-59 | US8840895 SEQ ID NO: 1 | 6323 |
| HEPBD14 | Heavy chain variable region, HBV Ab | HFW141 | US7435414 SEQ ID NO: 35; US20060014937; WO2005100400; CN1980956 | 6324 |
| HEPBD15 | Heavy chain variable region, HBV Ab | | US7112664 SEQ ID NO: 8; US6680053, US6924368, US20020061581, US20040191259, US20050249753, WO2001092529 | 6325 |
| HEPBD16 | Heavy chain variable region, HBV Ab | Ab17.1.4 1 | USRE39586 SEQ ID NO: 4; US6146629; WO1997047653 | 6326 |
| HEPBD17 | Heavy chain variable region, HBV Ab | Ab 19.79.5 | USRE40831 SEQ ID NO: 4 | 6327 |
| HEPBD18 | Heavy chain variable region, HB V Ab | | US20150232537 SEQ ID NO: 7; WO2014048910; CA2884388; CN104662041A; EP2900692 | 6328 |
| HEPBD19 | Heavy chain variable region, HBV Ab | | WO2013165972 SEQ ID NO: 45 | 6329 |
| HEPBD20 | Heavy chain variable region, HBV Ab | | WO2013165972 SEQ ID NO: 54 | 6330 |
| HEPBD21 | Heavy chain variable region, HBV Ab | | WO2013165972 SEQ ID NO: 63 | 6331 |
| HEPBD22 | Heavy chain variable region, HBV Ab | | WO2013165972 SEQ ID NO: 72 | 6332 |
| HEPBD23 | Heavy chain variable region, HBV Ab | | WO2013165972 SEQ ID NO: 81 | 6333 |
| HEPBD24 | Heavy chain variable region, HBV Ab | | WO2013165972 SEQ ID NO: 90 | 6334 |
| HEPBD25 | Heavy chain variable region, HBV Ab | | WO2013165972 SEQ ID NO: 99 | 6335 |
| HEPBD26 | Heavy chain variable region, HBV Ab | | WO2013165972 SEQ ID NO: 108 | 6336 |
| HEPBD27 | Heavy chain variable region, HBV Ab | | WO2013165972 SEQ ID NO: 117 | 6337 |
| HEPBD28 | Heavy chain variable region, HBV Ab | | WO2013165972 SEQ ID NO: 126 | 6338 |
| HEPBD29 | Heavy chain variable region, HBV Ab | | WO2013165972 SEQ ID NO: 135 | 6339 |
| HEPBD30 | Heavy chain variable region, HBV Ab | | WO2013165972 SEQ ID NO: 144 | 6340 |
| HEPBD31 | Heavy chain variable region, HBV Ab | | WO2013165972 SEQ ID NO: 153 | 6341 |
| HEPBD32 | Heavy chain variable region, HBV Ab | | WO2013165972 SEQ ID NO: 162 | 6342 |

TABLE 23-continued

Antibodies against Hepatitis B, C, D viruses

| Antibody No. | Description | Antibody Name | Reference Information | SEQ ID NO |
|---|---|---|---|---|
| HEPBD33 | Heavy chain variable region, HBV Ab | | WO2013165972 SEQ ID NO: 171 | 6343 |
| HEPBD34 | Heavy chain variable region, HBV Ab | | WO2013165972 SEQ ID NO: 180 | 6344 |
| HEPBD35 | Heavy chain variable region, HBV Ab | | WO2013165972 SEQ ID NO: 189 | 6345 |
| HEPBD36 | Heavy chain variable region, HBV Ab | | WO2013165972 SEQ ID NO: 198 | 6346 |
| HEPBD37 | Heavy chain variable region, HBV Ab | | WO2013165972 SEQ ID NO: 207 | 6347 |
| HEPBD38 | Heavy chain variable region, HBV Ab | | WO2013165972 SEQ ID NO: 405 | 6348 |
| HEPBD39 | Heavy chain variable region, HBV Ab | | WO2013165972 SEQ ID NO: 409 | 6349 |
| HEPBD40 | Heavy chain variable region, HBV Ab | | WO2013165972 SEQ ID NO: 412 | 6350 |
| HEPBD41 | Heavy chain variable region, HBV Ab | | WO2013165972 SEQ ID NO: 418 | 6351 |
| HEPBD42 | Heavy chain variable region, HBV Ab | | WO2013165972 SEQ ID NO: 421 | 6352 |
| HEPBD43 | Heavy chain variable region, HBV Ab | | WO2009069916 SEQ ID NO: 1 | 6353 |
| HEPBD44 | Heavy chain variable region, HBV Ab | PE1-1 | WO1994011495 | 6354 |
| HEPBD45 | Heavy chain variable region, HBV Ab | ZM1-1 | WO1994011495 | 6355 |
| HEPBD46 | Heavy chain variable region, HBV Ab | ZM1-2 | WO1994011495 | 6356 |
| HEPBD47 | Heavy chain variable region, HBV Ab | MD3-4 | WO1994011495 | 6357 |
| HEPBD48 | Heavy chain variable region, HBV Ab | A2E2 | CN102757492 SEQ ID NO: 2 | 6358 |
| HEPBD49 | Heavy chain variable region, HBV Ab | C9G9 | CN102757492 SEQ ID NO: 6 | 6359 |
| HEPBD50 | Heavy chain variable region, HBV Ab | | CN104530228 SEQ ID NO: 3 | 6360 |
| HEPBD51 | Heavy chain variable region, HBV Ab | | CN104530228 SEQ ID NO: 4 | 6361 |
| HEPBD52 | Heavy chain variable region, HBV Ab | Ab19 | US8580256 SEQ ID NO: 2 | 6362 |
| HEPBD53 | Heavy chain variable region, HBV Ab | Ab17 | US8580256 SEQ ID NO: 4 | 6363 |
| HEPBD54 | Heavy chain variable region, HBV Ab | KR127 | US8420353 SEQ ID NO: 28 | 6364 |
| HEPBD55 | Heavy chain variable region, HBV Ab | DP7 | US8420353 SEQ ID NO: 32 | 6365 |
| HEPBD56 | Heavy chain variable region, HBV Ab | HZ1 | US8420353 SEQ ID NO: 36 | 6366 |
| HEPBD57 | Heavy chain variable region, HCV Ab | MBL-HCV1 (Antibody produced by clone 83-128) | US8551484 SEQ ID NO: 1 | 6367 |
| HEPBD58 | Heavy chain variable region, HCV Ab | MBL-HCV1 (Antibody produced by clone 95-2) | US8551484 SEQ ID NO: 3 | 6368 |
| HEPBD59 | Heavy chain variable region, HCV Ab | MBL-HCV1 (Antibody produced by clone 95-14) | US8551484 SEQ ID NO: 5 | 6369 |
| HEPBD60 | Heavy chain variable region, HCV Ab | Clone 13 | US7250166 SEQ ID NO: 1 | 6370 |
| HEPBD61 | Heavy chain variable region, HCV Ab | Clone 98 | US7250166 SEQ ID NO: 3 | 6371 |
| HEPBD62 | Heavy chain variable region, HCV Ab | Clone 1:4 | US7250166 SEQ ID NO: 5 | 6372 |
| HEPBD63 | Heavy chain variable region, HCV Ab | Clone 1:8 | US7250166 SEQ ID NO: 7 | 6373 |
| HEPBD64 | Heavy chain variable region, HCV Ab | Clone 1:9 | US7250166 SEQ ID NO: 9 | 6374 |
| HEPBD65 | Heavy chain variable region, HCV Ab | Clone 1:10 | US7250166 SEQ ID NO: 11 | 6375 |
| HEPBD66 | Heavy chain variable region, HCV Ab | Clone 4:6 | US7250166 SEQ ID NO: 13 | 6376 |

TABLE 23-continued

Antibodies against Hepatitis B, C, D viruses

| Antibody No. | Description | Antibody Name | Reference Information | SEQ ID NO |
|---|---|---|---|---|
| HEPBD67 | Heavy chain variable region, HCV Ab | Clone 6a:5 | US7250166 SEQ ID NO: 15 | 6377 |
| HEPBD68 | Heavy chain variable region, HCV Ab | Clone2a:2 | US7250166 SEQ ID NO: 17 | 6378 |
| HEPBD69 | Heavy chain variable region, HCV Ab | Clone 2a:4 | US7250166 SEQ ID NO: 19 | 6379 |
| HEPBD70 | Heavy chain variable region, HCV Ab | Clone 2a:5 | US7250166 SEQ ID NO: 21 | 6380 |
| HEPBD71 | Heavy chain variable region, HCV Ab | Clone 2a:13 | US7250166 SEQ ID NO: 23 | 6381 |
| HEPBD72 | Heavy chain variable region, HCV Ab | Clone 2a:14 | US7250166 SEQ ID NO: 25 | 6382 |
| HEPBD73 | Heavy chain variable region, HCV Ab | Clone 2a:23 | US7250166 SEQ ID NO: 27 | 6383 |
| HEPBD74 | Heavy chain variable region, HCV Ab | Clone 2a:23 | US7250166 SEQ ID NO: 29 | 6384 |
| HEPBD75 | Heavy chain variable region, HCV Ab | Clone 2a:25 | US7250166 SEQ ID NO: 31 | 6385 |
| HEPBD76 | Heavy chain variable region, HCV Ab | Clone 2a:30 | US7250166 SEQ ID NO: 33 | 6386 |
| HEPBD77 | Heavy chain variable region, HCV Ab | Clone 2a:32 | US7250166 SEQ ID NO: 35 | 6387 |
| HEPBD78 | Heavy chain variable region, HCV Ab | Clone 2a:33 | US7250166 SEQ ID NO: 37 | 6388 |
| HEPBD79 | Heavy chain variable region, HCV Ab | Clone 2a:37 | US7250166 SEQ ID NO: 39 | 6389 |
| HEPBD80 | Heavy chain variable region, HCV Ab | Clone 2a:40 | US7250166 SEQ ID NO: 41 | 6390 |
| HEPBD81 | Heavy chain variable region, HCV Ab | Clone 2b:1 | US7250166 SEQ ID NO: 43 | 6391 |
| HEPBD82 | Heavy chain variable region, HCV Ab | Clone 2b:3 | US7250166 SEQ ID NO: 45 | 6392 |
| HEPBD83 | Heavy chain variable region, HCV Ab | Clone 2b:4 | US7250166 SEQ ID NO: 47 | 6393 |
| HEPBD84 | Heavy chain variable region, HCV Ab | Clone 2b:5 | US7250166 SEQ ID NO: 49 | 6394 |
| HEPBD85 | Heavy chain variable region, HCV Ab | Clone 2b:7 | US7250166 SEQ ID NO: 51 | 6395 |
| HEPBD86 | Heavy chain variable region, HCV Ab | Clone 2b:9 | US7250166 SEQ ID NO: 53 | 6396 |
| HEPBD87 | Heavy chain variable region, HCV Ab | Clone 2b:10 | US7250166 SEQ ID NO: 55 | 6397 |
| HEPHD88 | Heavy chain variable region, HCV Ab | anti-NS3 Fab | US7314919 SEQ ID NO: 1 | 6398 |
| HEPBD89 | Heavy chain variable region, HCV Ab | Antibody produced by clone 95-14 | US8551484 SEQ ID NO: 32 | 6399 |
| HEPBD90 | Heavy chain variable region, HCV Ab | Antibody produced by clone 95-38 | US8551484 SEQ ID NO: 33 | 6400 |
| HEPBD91 | Heavy chain variable region, HCV Ab | Antibody produced by clone 95-25 | US8551484 SEQ ID NO: 34 | 6401 |
| HEPBD92 | Heavy chain variable region, HCV Ab | Antibody produced by clone 95.42 | US8551484 SEQ ID NO: 35 | 6402 |
| HEPBD93 | Heavy chain variable region, HCV Ab | Antibody produced by clone 95-43 | US8551484 SEQ ID NO: 36 | 6403 |
| HEPBD94 | Heavy chain variable region, HCV Ab | Antibody produced by clone 95-49 | US8551484 SEQ ID NO: 37 | 6404 |
| HEPBD95 | Heavy chain variable region, HCV Ab | Antibody produced by clone 95-54 | US8551484 SEQ ID NO: 38 | 6405 |
| HEPBD96 | Heavy chain variable region, HCV Ab | Antibody produced by clone 95-58 | US8551484 SEQ ID NO: 39 | 6406 |
| HEPBD97 | Heavy chain variable region, HCV Ab | Antibody produced by clone 95-62 | US8551484 SEQ ID NO: 40 | 6407 |
| HEPBD98 | Heavy chain variable region, HCV Ab | HC-84.1 | US20130084301 SEQ ID NO: 55 | 6408 |

TABLE 23-continued

Antibodies against Hepatitis B, C, D viruses

| Antibody No. | Description | Antibody Name | Reference Information | SEQ ID NO |
|---|---|---|---|---|
| HEPBD99 | Heavy chain variable region, HCV Ab | HC-84.20 | US20130084301 SEQ ID NO: 56 | 6409 |
| HEPBD100 | Heavy chain variable region, HCV Ab | HC-84.21 | US20130084301 SEQ ID NO: 57 | 6410 |
| HEPBD101 | Heavy chain variable region, HCV Ab | HC-84.22 | US20130084301 SEQ ID NO: 58 | 6411 |
| HEPBD102 | Heavy chain variable region, HCV Ab | HC-23 | US20130084301 SEQ ID NO: 59 | 6412 |
| HEPBD103 | Heavy chain variable region, HCV Ab | HC-84.24 | US20130084301 SEQ ID NO: 60 | 6413 |
| HEPBD104 | Heavy chain variable region, HCV Ab | HC-84.25 | US20130084301 SEQ ID NO: 61 | 6414 |
| HEPBD105 | Heavy chain variable region, HCV Ab | HC-84.26 | US20130084301 SEQ ID NO: 62 | 6415 |
| HEPBD106 | Heavy chain variable region, HCV Ab | HC-84.27. | US20130084301 SEQ ID NO: 63 | 6416 |
| HEPBD107 | Heavy chain variable region, HCV Ab | AOT3 | US20120009196 SEQ ID NO: 1 | 6417 |
| HEPBD108 | Heavy chain variable region, HCV Ab | C11-3 | US20120009196 SEQ ID NO: 3 | 6418 |
| HEPBD109 | Heavy chain variable region, HCV Ab | C11-7 | US20120009196 SEQ ID NO: 5 | 6419 |
| HEPBDI10 | Heavy chain variable region, HCV Ab | C11-9 | US20120009196 SEQ ID NO: 7 | 6420 |
| HEPBD111 | Heavy chain variable region, HCV Ab | C11-14 | US20120009196 SEQ ID NO: 9 | 6421 |
| HEPBD112 | Heavy chain variable region, HCV Ab | | WO2014065822 SEQ ID NO: 3 | 6422 |
| HEPBD113 | Heavy chain variable region, HCV Ab | | WO2014065822 SEQ ID NO: 7 | 6423 |
| HEPBD114 | Heavy chain variable region, HCV Ab | mPA-29 | WO2007143701 SEQ ID NO: 2 | 6424 |
| HEPBD115 | Heavy chain variable region, HCV Ab | Hc33.1 | Li Y. et al., Structural basis for penetration of the glycan shield of hepatitis C virUSe2 glycoprotein by a broadly neutralizing human antibody; J. Biol. Chem. 290 (16), 10117-10125 (2015) NCBI Accession # 4XVJ_H (141aa) | 6425 |
| HEPBD116 | Heavy chain variable region, HCV Ab | | Martin, F., et al., Affinity selection of a camelized V(H) domain antibody inhibitor of hepatitis C virUSNS3 protease; Protein Eng. 10(5), 607-614 (1997NCBI Accession # 1OL0_B (121aa) | 6426 |
| HEPBD117 | Heavy chain variable region, HCV Ab | | US20150118242 SEQ ID NO: 2 | 6427 |
| HEPBD118 | Heavy chain variable region, Human HBV antibody that binds to the surface antigen (HBsAg) | | US20150166637 SEQ ID NO: 1, WO2014010890; CA2878155, CN104487090, EP2858674 | 6428 |
| HEPBD119 | Heavy chain variable region, Human HBV antibody that binds to the surface antigen (HBsAg) | | US20150166637 SEQ ID NO: 2; WO2014010890; CA2878155, CN104487090, EP2858674 | 6429 |
| HEPBD120 | Heavy chain variable region, Human HBV antibody that binds to the surface antigen (HBsAg) | | US20150166637 SEQ ID NO: 3; WO2014010890; CA2878155, CN104487090, EP2858674 | 6430 |
| HEPBD121 | Heavy chain variable region, Human HBV antibody that binds to the surface antigen (HBsAg) | | US20150166637 SEQ ID NO: 4; WO2014010890; CA2878155, CN104487090, EP2858674 | 6431 |
| HEPBD122 | Heavy chain variable region, Human HBV antibody that binds to the surface antigen (HBsAg) | | US20150166637 SEQ ID NO: 5; WO2014010890; CA2878155, CN104487090, EP2858674 | 6432 |
| HEPBD123 | Heavy chain variable region, Monoclonal HBV antibody | c18/A2 | US20120308580 SEQ ID NO: 2; WO 2011062562; CN102781961, EP2501723 | 6433 |
| HEPBD124 | Heavy chain variable region, Neutralizing | | US20110097270 SEQ ID NO: 1 | 6434 |

TABLE 23-continued

Antibodies against Hepatitis B, C, D viruses

| Antibody No. | Description | Antibody Name | Reference Information | SEQ ID NO |
|---|---|---|---|---|
| | monoclonal HBV antibody | | | |
| HEPBD125 | Heavy chain, full HBV Ab | | US20150232537 SEQ ID NO: 9; WO2014048910; CA2884388; CN104662041A; EP2900692 | 6435 |
| HEPBD126 | Heavy chain, HBV Ab | HBFab21 | CN103588874 SEQ ID NO: 2 | 6436 |
| HEPBD127 | Heavy chain, HCV Ab | Fab clone 1:5 | US6747136 SEQ ID NO: 1 | 6437 |
| HEPBD128 | Heavy chain, HCV Ab | Fab clone 1:7 | US6747136 SEQ ID NO: 2 | 6438 |
| HEPBD129 | Heavy chain, ACV Ab | Fab clone 1:11 | US6747136 SEQ ID NO: 3 | 6439 |
| HEPBD130 | Heavy chain, HCV Ab | Fab clone L3 | US6747136 SEQ ID NO: 4 | 6440 |
| HEPBD131 | Heavy chain, HCV Ab | Fab clone L1 | US6747136 SEQ ID NO: 5 | 6441 |
| HEPBD132 | Heavy chain, HCV Ab | Fab clone A8 | US6747136 SEQ ID NO: 6 | 6442 |
| HEPBD133 | Heavy chain, HCV Ab | Fab clone A12 | US6747136 SEQ ID NO: 7 | 6443 |
| HEPBD134 | Heavy chain, HCV Ab | HCV-AB 68 | US7241445 SEQ ID NO: 3 | 6444 |
| HEPBD135 | Heavy chain, HCV Ab | e8 | US7727529 SEQ ID NO: 1 | 6445 |
| HEPBD136 | Heavy chain, HCV Ab | e10 | US7727529 SEQ ID NO: 3 | 6446 |
| HEPBD137 | Heavy chain, HCV Ab | e20 | US7727529 SEQ ID NO: 5 | 6447 |
| HEPBD138 | Heavy chain, HCV Ab | e137 | US7727529 SEQ ID NO: 7 | 6448 |
| HEPBD139 | Heavy chain, HCV Ab | e301 | US7727529 SEQ ID NO: 9 | 6449 |
| HEPBD140 | Heavy chain, HCV Ab | e509 | US7727529 SEQ ID NO: 11 | 6450 |
| HEPBD141 | Heavy chain, HCV Ab | 5D2 | US20090104207 SEQ ID NO: 7 | 6451 |
| HEPBD142 | Heavy chain, HCV Ab | Mab V | WO2013186752 SEQ ID NO: 3 | 6452 |
| HEPBD143 | Heavy chain, HCV Ab | Mab VI | WO2013186752 SEQ ID NO: 5 | 6453 |
| HEPBD144 | Heavy chain, HCV Ab | | WO2007143701 SEQ ID NO: 12 | 6454 |
| HEPBD145 | Heavy chain, HCV Ab | HuPA29VH#1 | WO2007143701 SEQ ID NO: 15 | 6455 |
| HEPBD146 | Heavy chain, HCV Ab | HuPA29VH#2 | WO2007143701 SEQ ID NO: 16 | 6456 |
| HEPBD147 | Heavy chain, HCV Ab | HuPA29VH#3 | WO2007143701 SEQ ID NO: 17 | 6457 |
| HEPBD148 | Heavy chain, HCV Ab | PA29 | WO2007143701 SEQ ID NO: 28 | 6458 |
| HEPBD149 | Heavy chain, HCV Ab | Ap33 | Kong, L., et al., Structure of Hepatitis C Virus Envelope Glycoprotein E2 Antigenic Site 412 to 423 in Complex with Antibody AP33; J. Virol. 86 (23), 13085-13088 (2012) NCBI Accession # 4G6A _H (224aa) | 6459 |
| HEPBD50 | Heavy chain, HCV Ab | Single Chain Fv Fragment 1:7 | Gilmartin, A.A., et al., Protein Eng. Des. Sel. 25 (2), 59-66 (2012) NCBI Accession # 3U6R_A(149aa) | 6460 |
| HEPBD151 | Heavy Chain, HCV Fab | Ar3c | Kong, L., etal., Hepatitis C virUSE2 envelope glycoprotein core structure; Science 342 (6162), 1090-1094 (2013) NCBI Accession # 4MWF_A (233aa) | 6461 |
| HEPBD152 | Heavy Chain, HCV Fab | Mrct10.v362 | Pantua, H., et al., Glycan shifting on hepatitis C virus (HCV) e2 glycoprotein is a mechanism for escape from broadly neutralizing antibodies; J. Mol. Biol. 425 (11), 1899-1914 (2013) NCBI Accession # HS6_H (226aa) | 6462 |
| HEPBD153 | Heavy Chain, Hcv1 HCV Ab | Hcv1, P2(1) Form | Kong, L., et al., Structural basis of hepatitis C virus neutralization by broadly neutralizing antibody HCV1; Proc. Natl. Acad. Sci. U.S.A. 109 (24), 9499-9504 (2012) NCBI Accession # 4DGV_H (226aa) | 6463 |
| HEPBD154 | Heavy Chain, Hcv1 HCV Ab | Hcv1, C2 Form | Kong, L., etal., Structural basis of hepatitis C virus neutralization by broadly neutralizing antibody HCV1; Proc. Natl. Acad. Sci. U.S.A. 109 (24), 9499-9504 (2012) NCBI Accession # 4DGY_H (226aa) | 6464 |
| HEPBD155 | Heavy gamma chain variable, HCV Ab | P18-9E | US8592559 SEQ ID NO: 13 | 6465 |
| HEPBD156 | Heavy-chain-only, HCV Ab | VHH D03 | WO2014053634 SEQ ID NO: 4 | 6466 |
| HEPBD157 | Heavy-chain-only, HCV Ab | VHH C09 | WO2014053634 SEQ ID NO: 5 | 6467 |
| HEPBD158 | Heavy-chain-only, HCV Ab | B1 1 | WO2014053634 SEQ ID NO: 6 | 6468 |
| HEPBD159 | Heavy-chain-only, HCV Ab | D04 | WO2014053634 SEQ ID NO: 7 | 6469 |
| HEPBD160 | Light chain full, HBV Ab | | US20150232537 SEQ ID NO: 10; WO2014048910; CA2884388; CN104662041A; EP2900692 | 6470 |
| HEPBD161 | Light chain kappa, partial, HCV Ab | | Esposito, C., et al., Recombinant human antibodies specific for hepatitis C virus | 6471 |

TABLE 23-continued

Antibodies against Hepatitis B, C, D viruses

| Antibody No. | Description | Antibody Name | Reference Information | SEQ ID NO |
|---|---|---|---|---|
| | | | proteins; Arch. Virol. 142 (3), 601-610 (1997) NCBI Accession # CAA54913.1(110aa) | |
| HEPBD162 | Light chain variable domain, monoclonal HBV antibody | c18/A2 | US20120308580 SEQ ID NO: 1; WO 2011062562; CN102781961, EP2501723 | 6472 |
| HEPBD163 | Light chain variable domain, neutralizing monoclonal HBV antibody, | | US20110097270 SEQ ID NO: 9 | 6473 |
| HEPBD164 | Light chain variable gene, Chimeric HBV Ab | | EP0521348 | 6474 |
| HEPBD165 | Light chain variable region, HBV Ab | E183/A2 | US20120308580 SEQ ID NO: 32; WO 2011062562; CN102781961, EP2501723 | 6475 |
| HEPBD166 | Light chain variable region, HBV Ab | HB48-33 | US8840895 SEQ ID NO: 2 | 6476 |
| HEPBD167 | Light chain variable region, HBV Ab | HB48-35 | US8840895 SEQ ID NO: 3 | 6477 |
| HEPBD168 | Light chain variable region, HBV Ab | HB48-59 | US8840895 SEQ ID NO: 4 | 6478 |
| HEPBD169 | Light chain variable region, HBV Ab | LFW22-31 | US7435414 SEQ ID NO: 36; US20060014937; WO2005100400; CN1980956 | 6479 |
| HEPBD170 | Light chain variable region, HBV Ab | LFW22-312 | US7435414 SEQ ID NO: 37; US20060014937; WO2005100400; CN1980956 | 6480 |
| HEPBD171 | Light chain variable region, HBV Ab | | WO2013165972 SEQ ID NO: 216 | 6481 |
| HEPBD172 | Light chain variable region, HBV Ab | | WO2013165972 SEQ ID NO: 225 | 6482 |
| HEPBD173 | Light chain variable region, HBV Ab | | WO2013165972 SEQ ID NO: 234 | 6483 |
| HEPBD174 | Light chain variable region, HBV Ab | | WO2013165972 SEQ ID NO: 243 | 6484 |
| HEPBD175 | Light chain variable region, HBV Ab | | WO2013165972 SEQ ID NO: 252 | 6485 |
| HEPBD176 | Light chain variable region, HBV Ab | | WO2013165972 SEQ ID NO: 261 | 6486 |
| HEPBD177 | Light chain variable region, HBV Ab | | WO2013165972 SEQ ID NO: 270 | 6487 |
| HEPBD178 | Light chain variable region, HBV Ab | | WO2013165972 SEQ ID NO: 279 | 6488 |
| HEPBD179 | Light chain variable region, HBV Ab | | WO2013165972 SEQ ID NO: 288 | 6489 |
| HEPBD180 | Light chain variable region, HBV Ab | | WO2013165972 SEQ ID NO: 297 | 6490 |
| HEPBD181 | Light chain variable region, HBV Ab | | WO2013165972 SEQ ID NO: 306 | 6491 |
| HEPBD182 | Light chain variable region, HBV Ab | | WO2013165972 SEQ ID NO: 315 | 6492 |
| HEPBD183 | Light chain variable region, HBV Ab | | WO2013165972 SEQ ID NO: 324 | 6493 |
| HEPBD184 | Light chain variable region, HBV Ab | | WO2013165972 SEQ ID NO: 333 | 6494 |
| HEPBD185 | Light chain variable region, HBV Ab | | WO2013165972 SEQ ID NO: 342 and 351 | 6495 |
| HEPBD186 | Light chain variable region, HBV Ab | | WO2013165972 SEQ ID NO: 360 | 6496 |
| HEPBD187 | Light chain variable region, HBV Ab | | WO2013165972 SEQ ID NO: 369 | 6497 |
| HEPBD188 | Light chain variable region, HBV Ab | | WO2013165972 SEQ ID NO: 378 | 6498 |
| HEPBD189 | Light chain variable region, HBV Ab | | WO2013165972 SEQ ID NO: 387 | 6499 |
| HEPBD190 | Light chain variable region, HBV Ab | | WO2013165972 SEQ ID NO: 396 | 6500 |
| HEPBD191 | Light chain variable region, HBV Ab | | WO2009069916 SEQ ID NO: 2 | 6501 |
| HEPBD192 | Light chain variable region, HBV Ab | PE1-1 | WO1994011495 | 6502 |
| HEPBD193 | Light chain variable region, HBV Ab | ZM1-1 | WO1994011495 | 6503 |

TABLE 23-continued

Antibodies against Hepatitis B, C, D viruses

| Antibody No. | Description | Antibody Name | Reference Information | SEQ ID NO |
|---|---|---|---|---|
| HEPBD194 | Light chain variable region, HB V Ab | ZM1-2 | WO1994011495 | 6504 |
| HEPBD195 | Light chain variable region, HBV Ab | MD3-4 | WO1994011495 | 6505 |
| HEPBD196 | Light chain variable region, HBV Ab | A2E2 | CN102757492 SEQ ID NO: 4 | 6506 |
| HEPBD197 | Light chain variable region, HBV Ab | C9G9 | CN102757492 SEQ ID NO: 8 | 6507 |
| HEPBD198 | Light chain variable region, HBV Ab | | CN104530228 SEQ ID NO: 1 | 6508 |
| HEPBD199 | Light chain variable region, HBV Ab | | CN104530228 SEQ ID NO: 2 | 6509 |
| HEPBD200 | Light chain variable region, HBV Ab | Ab19 | US8580256 SEQ ID NO: 1 | 6510 |
| HEPBD201 | Light chain variable region, HBV Ab | Ab17 | US8580256 SEQ ID NO: 3 | 6511 |
| HEPBD202 | Light chain variable region, HBV Ab | KR127 | US8420353 SEQ ID NO: 4 | 6512 |
| HEPBD203 | Light chain variable region, HBV Ab | KR127 | US8420353 SEQ ID NO: 2 | 6513 |
| HEPBD204 | Light chain variable region, HBV Ab | KR127 | US8420353 SEQ ID NO: 30 | 6514 |
| HEPBD205 | Light chain variable region, HBV Ab | DPK12 | US8420353 SEQ ID NO: 34 | 6515 |
| HEPBD206 | Light chain variable region, HBV Ab | HZI | US8420353 SEQ ID NO: 38 | 6516 |
| HEPBD207 | Light chain variable region, HBV Ab | | US7112664 SEQ ID NO: 7; US6680053, US6924368, US20020061581, US20040191259, US20050249753, WO2001092529 | 6517 |
| HEPBD208 | Light chain variable region, HBV Ab | Ab17.1.4 1 | USRE39586 SEQ ID NO: 2; US6146629; WO1997047653 | 6518 |
| HEPBD209 | Light chain variable region, HBV Ab | Ab 19.79.5 | USRE40831 SEQ ID NO: 2 | 6519 |
| HEPBD210 | Light chain variable region, HBV Ab | | US20150232537 SEQ ID NO: 8; WO2014048910; CA2884388; CN104662041A; EP2900692 | 6520 |
| HEPBD211 | Light chain variable region, HBV Ab | | US20100260712 SEQ ID NO: 2; WO2009069917 | 6521 |
| HEPBD212 | Light chain variable region, HBV Ab | | WO2015107126 SEQ ID NO: 4 | 6522 |
| HEPBD213 | Light chain variable region, HCV Ab | MBL-HCV1 (Antibody produced by clone 83-128) | US8551484 SEQ ID NO: 2 | 6523 |
| HEPBD214 | Light chain variable region, HCV Ab | MBL-HCV1 (Antibody produced by clone 95-2) | US8551484 SEQ ID NO: 4 | 6524 |
| HEPBD215 | Light chain variable region, HCV Ab | MBL-HV1 (Antibody produced by clone 073-1) | US8551484 SEQ ID NO: 6 | 6525 |
| HEPBD216 | Light chain variable region, HCV Ab | Clone 13 | US7250166 SEQ ID NO: 2 | 6526 |
| HEPBD217 | Light chain variable region, HCV Ab | Clone 98 | US7250166 SEQ ID NO: 4 | 6527 |
| HEPBD218 | Light chain variable region, HCV Ab | Clone 1:4 | US7250166 SEQ ID NO: 6 | 6528 |
| HEPBD219 | Light chain variable region, HCV Ab | Clone 1:8 | US7250166 SEQ ID NO: 8 | 6529 |
| HEPBD220 | Light chain variable region, HCV Ab | Clone 1:9 | US7250166 SEQ ID NO: 10 | 6530 |
| HEPBD221 | Light chain variable region, HCV Ab | Clone 1:10 | US7250166 SEQ ID NO: 12 | 6531 |
| HEPBD222 | Light chain variable region, HCV Ab | Clone 4:6 | US7250166 SEQ ID NO: 14 | 6532 |
| HEPBD223 | Light chain variable region, HCV Ab | Clone 6a:5 | US7250166 SEQ ID NO: 16 | 6533 |
| HEPBD224 | Light chain variable region, HCV Ab | Clone 2a:2 | US7250166 SEQ ID NO: 18 | 6534 |
| HEPBD225 | Light chain variable region, HCV Ab | Clone 2a:4 | US7250166 SEQ ID NO: 20 | 6535 |
| HEPBD226 | Light chain variable region, HCV Ab | Clone 2a:5 | US7250166 SEQ ID NO: 22 | 6536 |

TABLE 23-continued

Antibodies against Hepatitis B, C, D viruses

| Antibody No. | Description | Antibody Name | Reference Information | SEQ ID NO |
|---|---|---|---|---|
| HEPBD227 | Light chain variable region, HCV Ab | Clone 2a:13 | US7250166 SEQ ID NO: 24 | 6537 |
| HEPBD228 | Light chain variable region, HCV Ab | Clone 2a:14 | US7250166 SEQ ID NO: 26 | 6538 |
| HEPBD229 | Light chain variable region, HCV Ab | Clone 2a:23 | US7250166 SEQ ID NO: 28 | 6539 |
| HEPBD230 | Light chain variable region, HCV Ab | Clone 2a:23 | US7250166 SEQ ID NO: 30 | 6540 |
| HEPBD231 | Light chain variable region, HCV Ab | Clone 2a:25 | US7250166 SEQ ID NO: 32 | 6541 |
| HEPBD232 | Light chain variable region, HCV Ab | Clone 2a:30 | US7250166 SEQ ID NO: 34 | 6542 |
| HEPBD233 | Light chain variable region, HCV Ab | Clone 2a:32 | US7250166 SEQ ID NO: 36 | 6543 |
| HEPBD234 | Light chain variable region, HCV Ab | Clone 2a:33 | US7250166 SEQ ID NO: 38 | 6544 |
| HEPBD235 | light chain variable region, HCV Ab | Clone 2a:37 | US7250166 SEQ ID NO: 40 | 6545 |
| HEPBD236 | Light chain variable region, HCV Ab | Clone 2a:40 | US7250166 SEQ ID NO: 42 | 6546 |
| HEPBD237 | Light chain variable region, HCV Ab | Clone 2b:1 | US7250166 SEQ ID NO: 44 | 6547 |
| HEPBD238 | Light chain variable region, HCV Ab | Clone 2b:3 | US7250166 SEQ ID NO: 46 | 6548 |
| HEPBD239 | Light chain variable region, HCV Ab | Clone 2b:4 | US7250166 SEQ ID NO: 48 | 6549 |
| HEPBD240 | Light chain variable region, HCV Ab | Clone 2b:5 | US7250166 SEQ ID NO: 50 | 6550 |
| HEPBD241 | Light chain variable region, HCV Ab | Clone 2b:7 | US7250166 SEQ ID NO: 52 | 6551 |
| HEPBD242 | Light chain variable region, HCV Ab | Clone 2b:9 | US7250166 SEQ ID NO: 54 | 6552 |
| HEPBD243 | Light chain variable region, HCV Ab | Clone 2b:10 | US7250166 SEQ ID NO: 56 | 6553 |
| HEPBD244 | Light chain variable region, HCV Ab | anti-NS3 Fab | US7314919 SEQ ID NO: 6 | 6554 |
| HEPBD245 | Light chain variable region, HCV Ab | | US7507408 SEQ ID NO: 2 | 6555 |
| HEPBD246 | Light chain variable region, HCV Ab | | US7507408 SEQ ID NO: 4 | 6556 |
| HEPBD247 | Light chain variable region, HCV Ab | | US7507408 SEQ ID NO: 6 | 6557 |
| HEPBD248 | Light chain variable region, HCV Ab | Antibody produced by clone 95-14 | US8551484 SEQ ID NO: 44 | 6558 |
| HEPBD249 | Light chain variable region, HCV Ab | Antibody produced by clone 95-38 | US8551484 SEQ ID NO: 53 | 6559 |
| HEPBD250 | Light chain variable region, HCV Ab | HC-84.1 | US20130084301 SEQ ID NO: 64 | 6560 |
| HEPBD251 | Light chain variable region, HCV Ab | HC-84.20 | US20130084301 SEQ ID NO: 65 | 6561 |
| HEPBD252 | Light chain variable region, HCV Ab | HC-84.21 | US20130084301 SEQ ID NO: 66 | 6562 |
| HEPBD253 | Light chain variable region, HCV Ab | HC-84.22 | US20130084301 SEQ ID NO: 67 | 6563 |
| HEPBD254 | Light chain variable region, HCV Ab | HC-23 | US20130084301 SEQ ID NO: 68 | 6564 |
| HEPBD255 | Light chain variable region, HCV Ab | HC-84.24 | US20130084301 SEQ ID NO: 69 | 6565 |
| HEPBD256 | Light chain variable region, HCV Ab | HC-84.25 | US20130084301 SEQ ID NO: 70 | 6566 |
| HEPBD257 | Light chain variable region, HCV Ab | HC-84,26 | US20130084301 SEQ ID NO: 71 | 6567 |
| HEPBD258 | Light chain variable region, HCV Ab | HC-84.27. | US20130084301 SEQ ID NO. 72 | 6568 |
| HEPBD259 | Light chain variable region, HCV Ab | AOT3 | US20120009196 SEQ ID NO: 2 | 6569 |
| HEPBD260 | Light chain variable region, HCV Ab | C11-3 | US20120009196 SEQ ID NO: 4 | 6570 |
| HEPBD261 | Light chain variable region, HCV Ab | C11-7 | US20120009196 SEQ ID NO: 6 | 6571 |
| HEPBD262 | Light chainvariable region, HCV Ab | C11-9 | US20120009196 SEQ ID NO: 8 | 6572 |

TABLE 23-continued

Antibodies against Hepatitis B, C, D viruses

| Antibody No. | Description | Antibody Name | Reference Information | SEQ ID NO |
|---|---|---|---|---|
| HEPBD263 | Light chain variable region, HCV Ab | C11-14 | US20120009196 SEQ ID NO: 10 | 6573 |
| HEPBD264 | Light chain variable region, HCV Ab | | WO2014065822 SEQ ID NO: 5 | 6574 |
| HEPBD265 | Light chain variable region, HCV Ab | | WO2014065822 SEQ ID NO: 9 | 6575 |
| HEPBD266 | Light chain variable region, HCV Ab | Antibody light chain from WO2007143701 | WO2007143701 SEQ ID NO: 1 | 6576 |
| HEPBD267 | Light chain variable region, HCV Ab | Hc33.1 | Li Y. et al., Structural basis for penetration of the glycan shield of hepatitis C virUSe2 glycoprotein by a broadly neutralizing human antibody; J. Biol. Chem. 290 (16), 10117-10125 (2015) NCBI Accession # 4XVJ_L (115aa) | 6577 |
| HEPBD268 | Light chain variable region, HCV Ab | | US20150118242 SEQ ID NO: 3 | 6578 |
| HEPBD269 | Light chain variable region, Human HVB antibody that binds to the surface antigen (HBsAg) | | US20150166637 SEQ ID NO: 6; WO2014010890; CA2878155, CN104487090; EP2858674 | 6579 |
| HEPBD270 | Light chain variable region, Human HBV antibody that binds to the surface antigen (HBsAg) | | US20150166637 SEQ ID NO: 7; WO2014010890; CA2878155, CN104487090, EP2858674 | 6580 |
| HEPBD271 | Light chain variable region, Human HBV antibody that binds to the surface antigen (HBsAg) | | US20150166637 SEQ ID NO: 8; WO2014010890; CA2878155, CN104487090, EP2858674 | 6581 |
| HEPBD272 | Light chain variable region, Human HBV antibody that binds to the surface antigen (HBsAg) | | US20150166637 SEQ ID NO: 9; WO2014010890; CA2878155, CN104487090, EP2858674 | 6582 |
| HEPBD273 | Light chain variable region, Human HBV antibody that binds to the surface antigen (HBsAg) | | US20150166637 SEQ ID NO: 10; WO2014010890; CA2878155, CN104487090, EP2858674 | 6583 |
| HEPBD274 | Light chain variable region, partial, HCV Ab | | Keck, Z.Y., et al., Human monoclonal antibody to hepatitis C virUSE1 glycoprotein that blocks virus attachment and viral infectivity; J. Virol. 78(13), 7257-7263 (2004) NCBI Accession # AAS47840 (147aa) | 6584 |
| HEPBD275 | Light chain, HCV Ab | Hu5b3.v3 | Pantua, B., et al., Glycan shifting on hepatitis C virus (HCV) e2 glycoprotein is a mechanism for escape from broadly neutralizing antibodies; J. Mol. Biol. 425 (11), 1899-1914 (2013) NCBI Accession # 4HS8_L (218aa) | 6585 |
| HEPBD276 | Light chain, HCV Ab | Ap33 | Kong, L., et al., Structure of Hepatitis C Virus Envelope Glycoprotein E2 Antigenic Site 412 to 423 in Complex with Antibody AP33; J. Virol. 86 (23), 13085-13088 (2012) NCBI Accession # 4G6A_L (218aa) | 6586 |
| HEPBD277 | Light chain, HBV Ab | HBFab21 | CN103588874 SEQ ID NO: 1 | 6587 |
| HEPBD278 | Light chain, HBV Ab | Fab clone 1:5 | US6747136 SEQ ID NO: 8 | 6588 |
| HEPBD279 | Light chain, HCV Ab | Fab clone 1:7 | US6747136 SEQ ID NO: 9 | 6589 |
| HEPBD280 | Light chain, HCV Ab | Fab clone 1:11 | US6747136 SEQ ID NO: 10 | 6590 |
| HEPBD281 | Light chain, HCV Ab | Fab clone L3 | US6747136 SEQ ID NO: 11 | 6591 |
| HEPBD282 | Light chain, HCV Ab | Fab clone L1 | US6747136 SEQ ID NO: 12 | 6592 |
| HEPBD283 | Light chain, HCV Ab | Fab clone A8 | US6747136 SEQ ID NO: 13 | 6593 |
| HEPBD284 | Light chain, HCV Ab | Fab clone A12 | US6747136 SEQ ID NO: 14 | 6594 |
| HEPBD285 | Light chain, HCV Ab | HCV#1 | US6924362 SEQ ID NO: 1 | 6595 |
| HEPBD286 | Light chain, HCV Ab | HCV#4 | US6924362 SEQ ID NO: 2 | 6596 |
| HEPBD287 | Light chain, HCV Ab | HCV#7 | US6924362 SEQ ID NO: 3 | 6597 |
| HEPBD288 | Light chain, HEV Ab | HCV#12 | US6924362 SEQ ID NO: 4 | 6598 |
| HEPBD289 | Light chain, HCV Ab | HGV#13 | US6924362 SEQ ID NO: 5 | 6599 |
| HEPBD290 | Light chain, HCV Ab | HCV-AB 68 | US7241445 SEQ ID NO: 4 | 6600 |

TABLE 23-continued

Antibodies against Hepatitis B, C, D viruses

| Antibody No. | Antibody Description | Antibody Name | Reference Information | SEQ ID NO |
|---|---|---|---|---|
| HEPBD291 | Light chain, HCV Ab | e8 | US7727529 SEQ ID NO: 2 | 6601 |
| HEPBD292 | Light chain, HCV Ab | e10 | US7727529 SEQ ID NO: 4 | 6602 |
| HEPBD293 | Light chain, HEV Ab | e20 | US7727529 SEQ ID NO: 6 | 6603 |
| HEPBD294 | Light chain, HCV Ab | e137 | US7727529 SEQ ID NO: 8 | 6604 |
| HEPBD295 | Light chain, HCV Ab | e301 | US7727529 SEQ ID NO: 10 | 6605 |
| HEPBD296 | Light chain, HCV Ab | e509 | US7727529 SEQ ID NO: 12 | 6606 |
| HEPBD297 | Light chain, HCV Ab | 5D2 | US20090104207 SEQ ID NO: 8 | 6607 |
| HEPBD298 | Light chain, HCV Ab | MabV | WO2013186752 SEQ ID NO: 4 | 6608 |
| HEPBD299 | Light chain, HCV Ab | Mab VI | WO2013186752 SEQ ID NO: 6 | 6609 |
| HEPBD300 | Light chain, HCV Ab | | WO2007143701 SEQ ID NO: 11 | 6610 |
| HEPBD301 | Light chain, HCV Ab | HuPA29VH#1 | WO2007143701 SEQ ID NO: 18 | 6611 |
| HEPBD302 | Light chain, HCV Ab | HuPA29VH#2 | WO2007143701 SEQ ID NO: 19 | 6612 |
| HEPBD303 | Light chain, HCV Ab | PA29 | WO2007143701 SEQ ID NO: 29 | 6613 |
| HEPBD304 | Light chain, HCV Ab | Single Chain Fv Fragment 1:7 | Gilmartin, A.A., et al., Protein Eng. Des. Sel. 25 (2), 59-66 (2012) NCBI Accession # 3U6R_B (143aa) | 6614 |
| HEPBD305 | Light chain, HCV Ab | Igh526 | Kong L., et al., Structure of Hepatitis C Virus Envelope Glycoprotein E1 Antigenic Site 314-324 in Complex with Antibody 1GH526; J. Mol. Biol. 427 (16), 2617-2628 (2015) NCBI Accession # 4N0Y_L (218aa) | 6615 |
| HEPBD306 | Light chain, HCV Fab | Ar3c | Kong, L., et al., Hepatitis C virUSE2 envelope glycoprotein core structure; Science 342 (6162), 1090-1094 (2013) NCBI Accession # 4MWF_B (214aa) | 6616 |
| HEPBD307 | Light chain, HCV Fab | Mrct10.v362 | Pantua, H., et al., Glycan shifting on hepatitis C virus (HCV) e2 glycoprotein is a mechanism for escape from broadly neutralizing antibodies; J. Mol. Biol. 425 (11), 1899-1914 (2013) NCBI Accession # 4HS6_L (218aa) | 6617 |
| HEPBD308 | Light chain, Hcv1 HCV Ab | Hcv1, C2 Form | Kong, L., et al., Structural basis of hepatitis C virus neutralization by broadly neutralizing antibody HCV1; Proc. Natl. Acad. Sci, U.S.A. 109 (24), 9499-9504 (2012) NCBI Accession # 4DGY_L (213aa) | 6618 |
| HEPBD309 | Light chain, Hcv1 HCV Ab | Hcv1, P2(1) Form | Kong, L., et al., Structural basis of hepatitis C virus neutralization by broadly neutralizing antibody HCV1; Proc. Natl. Acad. Sci, U.S.A. 109 (24), 9499-9504 (2012) NCBI Accession # 4DGV_L (213aa) | 6619 |
| HEPBD310 | Light kappa chain variable, HCV Ab | P18-9E | US8592559 SEQ ID NO: 14 | 6620 |
| HEPBD311 | PEGylated anti-E2 heavy chain, HCV Ab | | WO2006028634 SEQ ID NO: 1 | 6621 |
| HEPBD312 | PEGylated anti-E2 heavy chain, HCV Ab | | WO2006028634 SEQ ID NO: 2 | 6622 |
| HEPBD313 | PEGylated anti-E2 heavy chain, HCV Ab | | WO2006028634 SEQ ID NO: 3 | 6623 |
| HEPBD314 | PEGylated anti-E2 heavy chain, HCV Ab | | WO2006028634 SEQ ID NO: 4 | 6624 |
| HEPBD315 | PEGylated anti-E2 heavy chain, HCV Ab | | WO2006028634 SEQ ID NO: 8 | 6625 |
| HEPBD316 | single chain, HBV Ab | | US6562599 SEQ ID NO: 4 | 6626 |
| HEPBD317 | single chain, HBV Ab | | US6562599 SEQ ID NO: 6 | 6627 |

In one embodiment, the payload region of the AAV particle comprises one or more nucleic acid sequences, fragment or variants thereof or encodes one or more polypeptides, fragments or variants thereof described in U.S. Pat. Nos. 7,241,445, and 8,858,947, the contents of each of which are herein incorporated by reference in their entirety, against HCV.

In one embodiment, the payload region of the AAV particle comprises one or more nucleic acid sequences, fragment or variants thereof or encodes one or more polypeptides, fragments or variants thereof described in US Publication No. US20150072885 and US20110046354, U.S. Pat. No. 5,204,095, European Publication No. EP0232921, EP0038642, and EP0186371, and International Publication No. WO1994011495, the contents of each of which are herein incorporated by reference in their entirety, against HBV.

In one embodiment, the payload region of the AAV particle comprises one or more nucleic acid sequences, fragment or variants thereof or encodes one or more polypeptides, fragments or variants thereof described in U.S. Pat. No. 6,020,195, the contents of which are herein incorporated by reference in their entirety, against HGV (hepatitis G virus).

In one embodiment, the payload region of the AAV particle comprises one or more nucleic acid sequences encoding one or more of the payload antibody polypeptides listed in Table 24 against Herpes Virus.

TABLE 24

Antibodies against Herpesvirus

| Antibody No. | Description | Antibody Name | Reference Information | SEQ ID NO |
|---|---|---|---|---|
| HERP1 | Chain A, HSV | E317 Fab | Lee, C. et al., "Structural basis for the antibody neutralization of herpes simplex virus" Acta Crystallogr. D Biol. Crystallogr. 69 (PT 10), 1935-1945 (2013), NCBI Accession # 3W9D_A | 6628 |
| HERP2 | Chain B, HSV | E317 Fab | Lee, C. et al., "Structural basis for the antibody neutralization of herpes simplex virus" Acta Crystallogr. D Biol. Clystallogr. 69 (PT 10), 1935-1945 (2013), NCBI Accession # 3W9D_B | 6629 |
| HERP3 | Chain C, HSV | E317 Fab | Lee, C. et al., "Structural basis for the antibody neutralization of herpes simplex virus" Acta Crystatlogr. D Biol. Crystallogr. 69 (PT 10), 1935-1945 (2013), NCBI Accession # 3W9D_C | 6630 |
| HERP4 | Chain D, HSV | E317 Fab | Lee, C. et al., "Structural basis for the antibody neutralization of herpes simplex virus" Acta Crystallogr. D Biol. Clystallogr. 69 (PT 10), 1935-1945 (2013), NCBI Accession # 3W9D_D | 6631 |
| HERP5 | Chimeric anti-EBVs gp350 antibody | | Tanner, J.E., "Peptides Designed To Spatially Depict the Epstein-Barr Virus Major Virion Glycoprotein gp350 Neutralization Epitope Elicit Antibodies That Block Virus-Neutralizing Antibody 72A1 Interaction with the Native gp350 Molecule"", J. Virol. 89 (9), 4932-4911(2015), NCBI Accession #AJR20276 | 6632 |
| HERP6 | Chimeric anti-EBVs gp350 antibody | | Tanner, J.E., "Peptides Designed To Spatially Depict the Epstein-Barr Virus Major Virion Glycoprotein gp350 Neutralization Epitope Elicit Antibodies That Block Virus-Neutralizing Antibody 72A1 Interaction with the Native gp350 Molecule"", J. Virol. 89 (9), 4932-4941 (2015), NCBI Accession #AJR20275 | 6633 |
| HERP7 | CMV | AE11F/3-20L1 | Lantto, J. et al., Binding characteristics determine the neutralizing potential of antibody fragments specific for antigenic domain 2 on glycoprotein B of human cytomegalovirus, Virology 305 (1), 201-209 (2003), NCBI Accession # AAN87569.1 (256 aa) | 6634 |
| HERP8 | Fv, EBV | G5 | Fang, C.Y., "Modulation of Epstein-Barr virus latent membrane protein 1 activity by intrabodies", Intervirology 50 (4), 254-263 (2007), NCBI Accession #ABA55015 | 6635 |
| HERP9 | Fv, EBV | A4 | Fang, C.Y., "Modulation of Epstein-Barr virus latent membrane protein 1 activity by intrabodies", Intervirology 50(4), 254-263 (2007), NCBI Accession #ABA55014 | 6636 |
| HERP10 | Fv, EBV | B8 | Fang, CY., "Modulation of Epstein-Barr virus latent membrane protein 1 activity by intrabodies", Intervirology 50 (4), 254-263 (2007), NCBI Accession #ABA55013 | 6637 |
| HERP11 | Fv, EBV | F5 | Fang, C.Y., "Modulation of Epstein-Barr virus latent membrane protein 1 activity by intrabodies", Intervirology 50(4), 254-263 (2007), NCBI Accession #ABA55012 | 6638 |
| HERP12 | Fv, EBV | E2 | Fang, C.Y., "Modulation of Epstein-Barr virus latent membrane protein 1 activity by intrabodies", Intervirology 50 (4), 254-263 (2007), NCBI Accession #ABA55011 | 6639 |
| HERP13 | Fv, EBV | H3 | Fang, C,Y., "Modulation of Epstein-Barr virus latent membrane protein 1 activity by intrabodies", Intervirology 50 (4), 254-263 (2007), NCBI Accession #ABA55010 | 6640 |
| HERP14 | Heavy chain, FLAGhis tagged sequence, VZV | DDF-VZV1 | US20100074906 SEQ ID NO: 20 | 6641 |

TABLE 24-continued

Antibodies against Herpesvirus

| Antibody No. | Description | Antibody Name | Reference Information | SEQ ID NO |
|---|---|---|---|---|
| HERP15 | Heavy chain variable domain, clone 11, HSV | ACHDV1 | Burioni, R. et al. "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994), NCBI Accession # AAB29447 | 6642 |
| HERP16 | Heavy chain variable domain, clone 13, HSV | ACHDV1 | Burioni, R. et al. "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994), NCBI Accession # AAB29449 | 6643 |
| HERP17 | Heavy chain variable domain, clone 15, HSV | ACHDV2 | Burioni, R, et al, "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994), NCBI Accession # AAB29456 | 6644 |
| HERP18 | Heavy chain variable domain, clone 15, HSV | ACHDV1 | Burioni, R. et al. "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994,) NCBI Accession # AAB29450 | 6645 |
| HERP19 | Heavy chain variable domain, clone 18, HSV | ACHDV1 | Burioni, R. et al. "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994,) NCBI Accession # AAB29448 | 6646 |
| HERP20 | Heavy chain variable domain, clone 2, HSV | ACHDV1 | Burioni, R. et al. "Recombinant human Fab to glycoprotein D neutralizes infectivity and prevents cell-to-cell transmission of herpes simplex viruses 1 and 2 in vitro", Proc. Natl. Acad. Sci. U.S.A. 91 (1), 355-359 (1994), NCBI Accession # AAB29455 | 6647 |
| HERP21 | Heavy chain variable region, CMV | 1F7 | US8202518 SEQ ID NO: 5 | 6648 |
| HERP22 | Heavy chain variable region, CMV | Humanized 57.4 | WO2014200898 SEQ ID NO: 633 | 6649 |
| HERP23 | Heavy chain variable region, CMV | Humanized 57.4 | WO2014200898 SEQ ID NO: 634 | 6650 |
| HERP24 | Heavy chain variable region, CMV | Humanized 58.5 | WO2014200898 SEQ ID NO: 637 | 6651 |
| HERP25 | Heavy chain variable region, CMV | Humanized 58.5 | WO2014200898 SEQ ID NO: 638 | 6652 |
| HERP26 | Heavy chain variable region, CMV | Humanized 272.7 | WO2014200898 SEQ ID NO: 641 | 6653 |
| HERP27 | Heavy chain variable region, CMV | Humanized 276.10 | WO2014200898 SEQ ID NO: 644 | 6654 |
| HERP28 | Heavy chain variable region, CMV | Humanized 276.10 | WO2014200898 SEQ ID NO: 645 | 6655 |
| HERP29 | Heavy chain variable region, CMV | Sm5-1 | Li, B., Construction and characterization of a high-affinity humanized SMS-1 monoclonal antibody, Biochem. Biophys. Res. Commun. 357 (4), 951-956 (2007), NCBI Accession # ABI22831.1 | 6656 |
| HERP30 | Heavy chain variable region, CMV | | Schoppel, K. et al., Antibodies specific for the antigenic domain 1 of glycoprotein B (gpUL55) of human cytomegalovirus bind to different substructures, Virology 216 (1), 133- | 6657 |

TABLE 24-continued

Antibodies against Herpesvirus

| Antibody No. | Description | Antibody Name | Reference Information | SEQ ID NO |
|---|---|---|---|---|
| HERP1 | Heavy chain variable region, CMV | | 145 (1996), NCBI Accession # AAB26953.1 (163 aa) Schoppel, K. et al., Antibodies specific for the antigenic domain 1 of glycoprotein B (gpUL55) of human cytomegalovirus bind to different substructures, Virology 216 (1), 133-145 (1996), NCBI Accession # AAB26952.1 (161 aa) | 6658 |
| HERP32 | Heavy chain variable region, CMV | | Schoppel, K. et al., Antibodies specific for the antigenic domain 1 of glycoprotein B (gpUL55) of human cytomegalovirus bind to different substructures, Virology 216 (1), 133-145 (1996), NCBI Accession # AAB26951.1 (158 aa) | 6659 |
| HERP33 | Heavy chain variable region, CMV | | Potzsch, S., B Cell Repertoire Analysis Identifies New Antigenic Domains on Glycoprotein B of Human Cytomegalovirus which Are Target of Neutralizing Antibodies, NCBI Accession # AEF33814.1 | 6660 |
| HERP34 | Heavy chain variable region, CMV, a complex of human cytomegalovirus (hCMV) proteins UL130 and UL131A | 1F11 | US9149524 SEQ ID NO: 7 | 6661 |
| HERP35 | Heavy chain variable region, CMV, a complex of human cytomegalovirus (hCMV) proteins UL130 and UL131A | 2F4 | US9149524 SEQ ID NO: 17 | 6662 |
| HERP36 | Heavy chain variable region, CMV, a complex of human cytomegalovirus (hCMV) proteins UL130 and UL131A | 5A2 | US9149524 SEQ ID NO: 39 | 6663 |
| HERP37 | Heavy chain variable region, CMV, AD1 region of HMV glycoprotein gB | EV2038 | US8492529 SEQ ID NO: 10 | 6664 |
| HERP38 | Heavy chain variable region, EBV | | US20150064174 SEQ ID 1 | 6665 |
| HERP39 | Heavy chain variable region, EBV | | US20150064174 SEQ ID 2 | 6666 |
| HERP40 | Heavy chain variable region, gH glycoprotein of HCMV | HCMV16 | WO1994009136, FIG. 1 | 6667 |
| HERP41 | Heavy chain variable region, HSV | | Nejatollahi, F. and Bagheri, V., "Isolation of neutralizing human specific single-chain antibodies against Herpes Simplex Virus type 1 glycoproiein D", unpublished, NCBI Accession # AGO59015 | 6668 |
| HERP42 | Heavy chain variable region, HSV 1&2 | E317 | US8431118 SEQ ID NO: 1; US8252906 | 6669 |
| HERP43 | Heavy chain variable region, HSV 1&2 | E425 | US8431118 SEQ ID NO: 3; US8252906 | 6670 |
| HERP44 | Heavy chain variable region, HSV 1&2 | Y571 | US8431118 SEQ ID NO: 41; US8252906 | 6671 |

TABLE 24-continued

Antibodies against Herpesvirus

| Antibody No. | Description | Antibody Name | Reference Information | SEQ ID NO |
|---|---|---|---|---|
| HERP45 | Heavy chain variable region, VZV | | US5506132 SEQ ID NO: 4 | 6672 |
| HERP46 | Heavy chain variable region, VZV | DDF-VZV2 | US20100074906 SEQ ID NO: 26 | 6673 |
| HERP47 | Heavy chain without a signal sequence, CMV, AD1 region of HCMV glycoprote in gB | EV2038 | US8492529 SEQ ID NO: 6 | 6674 |
| HERP48 | Heavy chain, CMV | 8f9 | McLean, G.R. et al., Recognition of human cytomegalovirus by human primary immunoglobulins identifies an innate foundation to an adaptive immune response, J. Immunol. 174 (8), 4768-4778 (2005), NCBI Accession # CAE54374.1 | 6675 |
| HERP49 | Heavy chain, CMV | Mab 109 | Simpson, J.A. et al., Neutralizing monoclonal antibodies that distinguish three antigenic sites on human cytomegalovirus glycoprotein H have conformationally distinct binding sites, J. Virol. 67 (1), 489-496 (1993), NCBI Accession # AAB24505.1 (119 aa) | 6676 |
| HERP50 | Heavy chain, CMV | Mab 115 | Simpson, J.A. et al., Neutralizing monoclonal antibodies that distinguish three antigenic sites on human cytomegalovirus glycoprotein H have conformationaly distinct binding sites, J. Virol. 67 (1), 489-496 (1993), NCBI Accession # AAB24504.1 (117 aa) | 6677 |
| HERP51 | Heavy chain, CMV | Mab 33 | Simpson, J.A. et al., Neutralizing monoclonal antibodies that distinguish three antigenic sites on human cytomegalovirus glycoprotein H have conformationally distinct binding sites, J. Virol. 67 (1), 489-496 (1993), NCBI Accession # AAB24503.1 (120 aa) | 6678 |
| HERP52 | Heavy chain, CMV | Mab 5 | Simpson, J.A. et at, Neutralizing monoclonal antibodies that distinguish three antigenic sites on human cytomegalovirus glycoprotein H have conformationaly distinct binding sites, J. Virol. 67 (1), 489-496 (1993), NCBI Accession # AAB24502.1 (120 aa) | 6679 |
| HERP53 | Heavy chain, CMV, a combination of the hCMV proteins UL128, UL130 and UL131A | 6G4 | WO2010007463 SEQ ID NO: 7 | 6680 |
| HERP54 | Heavy chain, HHV-6 | | US20140093526 SEQ ID 12 | 6681 |
| HERP55 | Heavy chain, HSV 1&2 | FabHS V 8. | US6156313 SEQ ID NO: 2 | 6682 |
| HERP56 | Heavy chain, HSV 1&2 | 64-683 | US5646041 SEQ ID NO: 2; EP876478 | 6683 |
| HERP57 | Heavy chain, HSV 1&2 | H005157 | US20140302062 SEQ ID NO: 3 | 6684 |
| HERP58 | Heavy chain, HSV 1&2 | H005158 | US20140302062 SEQ ID NO: 4 | 6685 |
| HERP59 | Heavy chain, HSV 1&2 | H005159 | US20140302062 SEQ ID NO: 5 | 6686 |
| HERP60 | Heavy chain, HSV 1&2 | H005160 | US20140302062 SEQ ID NO: 6 | 6687 |
| HERP61 | Heavy chain, HSV 1&2 | H005188 | US20140302062 SEQ ID NO: 7 | 6688 |
| HERP62 | Heavy chain, HSV 1&2 | H005190 | US20140302062 SEQ ID NO: 8 | 6689 |

TABLE 24-continued

Antibodies against Herpesvirus

| Antibody No. | Description | Antibody Name | Reference Information | SEQ ID NO |
|---|---|---|---|---|
| HERP63 | Heavy chain, HSV 1&2 | H005192 | US20140302062 SEQ ID NO: 9 | 6690 |
| HERP64 | Light chain variable region, gH glycoprotein of HCMV | HCMV16 | WO1994009136, FIG. 2 | 6691 |
| HERP65 | Light chain recombinant, VZV | DDF-VZV1 | US20100074906 SEQ ID NO: 22 | 6692 |
| HERP66 | Light chain variable region, CMV | 1F7 | US8202518 SEQ ID NO: 10 | 6693 |
| HERP67 | Light chain variable region, CMV | Humanized 57.4 | WO2014200898 SEQ ID NO: 631 | 6694 |
| HERP68 | Light chain variable region, CMV | Humanized 57.4 | WO2014200898 SEQ ID NO: 632 | 6695 |
| HERP69 | Light chain variable region, CMV | Humanized 58.5 | WO2014200898 SEQ ID NO: 635 | 6696 |
| HERP70 | Light chain variable region, CMV | Humanized 58.5 | WO2014200898 SEQ ID NO: 636 | 6697 |
| HERP71 | Light chain variable region, CMV | Humanized 272.7 | WO2014200898 SEQ ID NO: 639 | 6698 |
| HERP72 | Light chain variable region, CMV | Humanized 272.7 | WO2014200898 SEQ ID NO: 640 | 6699 |
| HERP73 | Light chain variable region, CMV | Humanized 276.10 | WO2014200898 SEQ ID NO: 642 | 6700 |
| HERP74 | Light chain variable region, CMV | Humanized 276.10 | WO2014200898 SEQ ID NO: 643 | 6701 |
| HERP75 | Light chain variable region, CMV | Sm5-1 | Li, B., Construction and characterization of a high-affinity humanized SM5-1 monoclonal antibody, Biochem. Biophys. Res. Commun. 357 (4), 951-956 (2007), NCBI Accession # AB122832.1 | 6702 |
| HERP76 | Light chain variable region, CMV | 8f9 | Schoppel, K. et al., Antibodies specific for the antigenic domain 1 of glycoprotein B (gpUL55) of human cytomegalovirus bind to different substructures, Virology 216 (1), 133-145 (1996), NCBI Accession # AAB26956.1 (146 aa) | 6703 |
| HERP77 | Light chain variable region, CMV | | Schoppel, K. et al., Antibodies specific for the antigenic domain 1 of glycoprotein B (gpUL55) of human cytomegalovirus bind to different substructures, Virology 216 (1), 133-145 (1996), NCBI Accession # AAB26955.1 (141 aa) | 6704 |
| HERP78 | Light chain variable region, CMV | | Schoppel, K. et al., Antibodies specific for the antigenic domain 1 of glycoprotein B (gpUL55) of human cytomegalovirus bind to different substructures, Virology 216 (1), 133-45 (1996), NCBI Accession # AAB26954.1 (152 aa) | 6705 |
| HERP79 | Light chain variable region, CMV | | Potzsch, S., B Cell Repertoire Analysis Identifies New Antigenic Domains on Glycoprotein B of Human Cytomegalovirus which Are Target of Neutralizing Antibodies, NCBI Accession # AEF33824.1 | 6706 |
| HERP80 | Light chain variable region, CMV, a combination of the hCMV proteins UL128, UL130 and UL131A | 1F11 | US9149524 SEQ ID NO: 8 | 6707 |
| HERP81 | Light chain variable region, CMV, a | 2F4 | US9149524 SEQ ID NO: 18 | 6708 |

TABLE 24-continued

Antibodies against Herpesvirus

| Antibody No. | Description | Antibody Name | Reference Information | SEQ ID NO |
|---|---|---|---|---|
| | combination of the hCMV proteins UL128, ULL30 and UL131A | | | |
| HERP82 | Light chain variable region, CMV, a combination of the hCMV proteins IUL128, UL130 and UL131A | 5A2 | US9149524 SEQ ID NO: 40 | 6709 |
| HERP83 | Light chain variable region, CMV, AD1 region of HCMV glycoprotein gB | EV2038 | US8492529 SEQ ID NO. 12 | 6710 |
| HERP84 | Light chain variable region, EBV | | US20150064174 SEQ ID 3 | 6711 |
| HERP85 | Light chain variable region, EBV | | US20150064174 SEQ ID 4 | 6712 |
| HERP86 | Light chain variable region, HSV | | Nejatollahi, F. and Bagheri, V., "Isolation of neutralizing human specific single-chain antibodies against Herpes Simplex Virus type 1 glycoprotein D", unpublished", NCBI Accession # AGO59016 | 6713 |
| HERP87 | Light chain variable region, HSV 1&2 | E317 | US8431118 SEQ ID NO: 2; US8252906 | 6714 |
| HERP88 | Light chain variable region, HSV 1&2 | E425 | US8431118 SEQ ID NO: 4; US8252906 | 6715 |
| HERP89 | Light chain variable region, HSV 1&2 | Y571 | US8431118 SEQ ID NO: 42; US8252906 | 6716 |
| HERP90 | Light chain variable region, VZV | | US5506132 SEQ ID NO: 2 | 6717 |
| HERP91 | Light chain variable region, VZV | DDF-VZV2 | US20100074906 SEQ ID NO: 24 | 6718 |
| HERP92 | Light chain without a signal sequence, CMV, AD1 region of HCMV glycoprotein gB | EV2038 | US8492529 SEQ ID NO: 8 | 6719 |
| HERP93 | Light chain, CMV | 8f9 | McLean, G.R. et al., Recognition of human cytomegalovirus by human primary immunoglobulins identifies an innate foundation to an adaptive immune response, J. Immunol. 174 (8), 4768-4778 (2005), NCBI Accession # CAE54366.1 | 6720 |
| HERP94 | Light chain, CMV | Mab 109 | Simpson, J.A. et al., Neutralizing monoclonal antibodies that distinguish three antigenic sites on human cytomegalovirus glycoprotein H have conformationally distinct binding sites, J. Virol. 67 (1), 489-496 (1993), NCBI Accession # A AB24501.1 (111 aa) | 6721 |
| HERP95 | Light chain, CMV | Mab 115 | Simpson, J.A. et al., Neutralizing monoclonal antibodies that distinguish three antigenic sites on human cytomegalovirus glycoprotein H have conformationaly distinct binding sites, J. Virol. 67 (1), 489-496 (1993), NCBI Accession # AAB24500.1 (107 aa) | 6722 |

TABLE 24-continued

Antibodies against Herpesvirus

| Antibody No. | Description | Antibody Name | Reference Information | SEQ ID NO |
|---|---|---|---|---|
| HERP96 | Light chain, CMV | Mab 33 | Simpson, J.A. et al., Neutralizing monoclonal antibodies that distinguish three antigenic sites on human cytomegalovirus glycoprotein H have conformationally distinct binding sites, J. Virol. 67 (1), 489-496 (1993), NCBI Accession # AAB24499.1 (107 aa) | 6723 |
| HERP97 | Light chain, CMV | Mab 5 | Simpson, J.A. et al., Neutralizing monoclonal antibodies that distinguish three antigenic sites on human cytomegalovirus glycoprotein H have conformationally distinct binding sites, J. Virol. 67 (1), 489-496 (1993), NCBI Accession # AAB24498.1 (107 aa) | 6724 |
| HERP98 | Light chain, CMV, a combination of the hCMV proteins UL128, UL130 and UL131A | 6G4 | WO2010007463 SEQ ID NO: 8 | 6725 |
| HERP99 | Light chain, HHV-6 | | US20140093526 SEQ ID 10 | 6726 |
| HERP100 | Light chain, HSV 1&2 | 64-683 | US5646041 SEQ ID NO: 4; EP876478 | 6727 |
| HERP101 | Light chain, HSV 1&2 | K003927 | US20140302062 SEQ ID NO: 10 | 6728 |
| HERP102 | Light chain, HSV 1&2 | K003928 | US20140302062 SEQ ID NO: 11 | 6729 |
| HERP103 | Light chain, HSV 1&2 | K003929 | US20140302062 SEQ ID NO: 12 | 6730 |
| HERP104 | Light chain, HSV 1&2 | K003930 | US20140302062 SEQ ID NO: 13 | 6731 |
| HERP105 | Light chain, HSV 1&2 | K003946 | US20140302062 SEQ ID NO: 14 | 6732 |
| HERP106 | Light chain, HSV 1&2 | K003948 | US20140302062 SEQ ID NO: 15 | 6733 |
| HERP107 | Light chain, HSV 1&2 | K003949 | US20140302062 SEQ ID NO: 16 | 6734 |
| HERP108 | Light chain, HSV 1&2 | L00184-4 | US20140302062 SEQ ID NO: 17 | 6735 |
| HERP109 | Single chain Fv antibody, glycoprotein B recombinant, CMV | | Lantto, J. et al., Non-germ-line encoded residues are critical for effective antibody recognition of a poorly immunogenic neutralization epitope on glycoprotein B of human cytomegalovirus, Eur. J. Immunol. 32 (6), 1659-1669 (2002), NCBI Accession # AAM92769.1 (255 aa) | 6736 |

In one embodiment, the payload region of the AAV particle comprises one or more nucleic acid sequences, fragment or variants thereof or encodes one or more polypeptides, fragments or variants thereof described in International Publication No. WO2010109874, and WO1997026329, the contents of each of which are herein incorporated by reference in their entirety, against HSV.

In one embodiment, the payload region of the AAV particle comprises one or more nucleic acid sequences, fragment or variants thereof or encodes one or more polypeptides, fragments or variants thereof described in International Publication No. WO1995031546, the contents of which are herein incorporated by reference in their entirety, against VZV.

In one embodiment, the payload region of the AAV particle comprises one or more nucleic acid sequences encoding one or more of the payload antibody poly peptides listed in Table 25 against Coronavirus.

TABLE 25

Antibodies against Coronaviruses

| Antibody No. | Description | Antibody Name | Reference Information | SEQ ID NO |
|---|---|---|---|---|
| CORV1 | Heavy chain partial sequence, Human anti-SARS antibody, Ig | | Liu, J., unpublished, NCBI Accession # BAE94186.1(228aa) | 6737 |

TABLE 25-continued

Antibodies against Coronaviruses

| Antibody No. | Description | Antibody Name | Reference Information | SEQ ID NO |
|---|---|---|---|---|
| CORV2 | Heavy chain partial sequence Human SARS neutralization antibody, Ig | H12 | AAX19356.1(127aa) | 6738 |
| CORV3 | Heavy chain variable partial sequence, Human neutralizing SARS antibody | | Leung et at., PLoS Med. 3 (7), E237 (2006), NCBI Accession # ABA54614.1(113aa) | 6739 |
| CORV4 | Heavy chain variable region, Human anti-SARS antibody | M396 | Prabakaran etal., J. Biol. Chem. 281 (23), 15829-15836 (2006), NCBI Accession # 2G75_D (213aa) | 6740 |
| CORV5 | Heavy chain variable region, Human neutralizing SARS antibody | | Prabakaran etal., J. Biol. Chem. 281 (23), 15829-15836 (2006), NCBI Accession # 2DD8_L (213aa) | 6741 |
| CORV6 | Heavy chain variable region, Humanized neutralizing murine monoclonal MERS | | CN103864924 SEQ ID NO: 1 | 6742 |
| CORV7 | Heavy chain variable region, MERs | | CN104447986 SEQ ID NO: 1 | 6743 |
| CORV8 | Heavy chain variable region, Neutralizing antibody (binds to the spike protein (5) of SARS-cov) | | US7750123 SEQ ID NO: 12; WO2005060520; CN1914226; US20050249739 | 6744 |
| CORV9 | Heavy chain variable region, SARS antibody | s110.4 | US20110159001 SEQ ID NO: 62; WO2009128963; EP2242768; CN102015767 | 6745 |
| CORV10 | Heavy chain variable region, SARS antibody | s124.5 | US20110159001 SEQ ID NO: 66; WO2009128963; EP2242768; CN102015767 | 6746 |
| CORV11 | Heavy chain variable region, SARS antibody | s215.17 | US20110159001 SEQ ID NO: 70; WO2009128963; EP2242768; CN102015767 | 6747 |
| CORV12 | Heavy chain variable region, SARS antibody | s218.9 | US20110159001 SEQ ID NO: 74; WO2009128963; EP2242768; CN102015767 | 6748 |
| CORV13 | Heavy chain variable region, SARS antibody | s223.4 | US20110159001 SEQ ID NO: 78; WO2009128963; EP2242768; CN102015767 | 6749 |
| CORV14 | Heavy chain variable region, SARS antibody | s22512 | US20110159001 SEQ ID NO: 82; WO2009128963; EP2242768; CN102015767 | 6750 |
| CORV15 | Heavy chain variable region, SARS antibody | s231.19 | US20110159001 SEQ ID NO: 86; WO2009128963; EP2242768; CN102015767 | 6751 |
| CORV16 | Heavy chain variable region, SARS antibody | s230.14 + 15 | US20110159001 SEQ ID NO: 90; WO2009128963; EP2242768; CN102015767 | 6752 |
| CORV17 | Heavy chain variable region, SARS antibody | s227. 14 | US20110159001 SEQ ID NO: 94; WO2009128963; EP2242768; CN102015767 | 6753 |
| CORV18 | Heavy chain variable region, SARS antibody | s109.8 | US20110159001 SEQ ID NO: 98; WO2009128963; EP2242768; CN102015767 | 6754 |
| CORV19 | Heavy chain variable region, SARS antibody | Fab58 | CN1513874 | 6755 |
| CORV20 | Heavy chain variable region, SARS antibody | Fab59 | CN1513874 | 6756 |
| CORV21 | Heavy chain variable region, SARS human monoclonal antibody | 3C7 | US7728110 SEQ ID NO: 60; WO2008060331; EP2035454A2, US20080248043 | 6757 |
| CORV22 | Heavy chain variable region, SARS human monoclonal antibody | F26G18 | US7622112 SEQ ID NO: 5; WO2005054469; US20080248043; US20080081047 | 6758 |
| CORV23 | Heavy chain variable region A, humanized antibody binding to S2 domain of SARS | | WO2006095180 SEQ ID NO: 24 | 6759 |
| CORV24 | Heavy chain Humanized neutralizing murine monoclonal MERS | | CN103864924 SEQ ID NO: 3 | 6760 |
| CORV25 | Heavy chain, MERS | m336 | WO2015057942 SEQ ID NO: 1 | 6761 |
| CORV26 | Heavy chain, MERS | m337 | WO2015057942 SEQ ID NO: 9 | 6762 |
| CORV27 | Fleavy chain, MERS | m338 | WO2015057942 SEQ ID NO: 16 | 6763 |
| CORV28 | Heavy chain, MERS | 2e 6 | CN104447986 SEQ ID NO: 3 | 6764 |

TABLE 25-continued

Antibodies against Coronaviruses

| Antibody No. | Description | Antibody Name | Reference Information | SEQ ID NO |
|---|---|---|---|---|
| CORV29 | Heavy chain, MERS | M336 | Ying et al., Nat Commun 6, 8223 (2015), NCBI Accession # 4XAK_H(252aa) | 6765 |
| CORV30 | Human anti-SARS antibody | | Leung et al., PLoS Med. 3 (7), E237 (2006), NCBI Accession # ABA54613.1(117aa) | 6766 |
| CORV31 | Human monoclonal MERS | Mers-27 | CN104628848 SEQ ID NO: 1 | 6767 |
| CORV32 | Human monoclonal MERS | Mers-27 | CN104628848 SEQ ID NO. 3 | 6768 |
| CORV33 | Human monoclonal MERS | Mers-4 | CN104628849 SEQ ID NO: 1 | 6769 |
| CORV34 | Human monoclonal MERS | Mers-4 | CN104628849 SEQ ID NO: 3 | 6770 |
| CORV35 | Kappa light chain partial sequence, human SARS neutralization antibody, Ig | H12 | AX19355.1(108aa) | 6771 |
| CORV36 | Light chain partial sequence, Human anti-SARS antibody, Ig | | Liu, J., unpublished, NCBI Accession # BAE94187.1(219aa) | 6772 |
| CORV37 | Light chain variable domain, MERS | | CN104447986 SEQ ID NO: 2 | 6773 |
| CORV38 | Light chain variable partial sequence, Human neutralizing SARS antibody | 80R | Hwang et al., J. Biol. Chem. 281 (45), 34610-34616 (2006), NCBI Accession # 2GHW_D (247aa) | 6774 |
| CORV39 | Light chain variable region, A humanized antibody binding to S2 domain of SARS | | WO2006095180 SEQ ID NO: 25 | 6775 |
| CORV40 | Light chain variable region, human anti-SARS antibody | M396 | Prabakaran et al., J. Biol. Chem. 281 (23), 15829-15836 (2006), NCBI Accession # 2G75_C (245aa) | 6776 |
| CORV41 | Light chain variable region, Human neutralizing SARS antibody | | Prabakaran et al., J. Biol. Chem. 281 (23), 15829-15836 (2006), NCBI Accession # 2DD8_H(245aa) | 6777 |
| CORV42 | Light chain variable region, Humanized neutralizing murine monoclonal MERS | | CN103864924 SEQ ID NO: 2 | 6778 |
| CORV43 | Light chain variable region, neutralizing antibody (binds to the spike protein (S) of SARS-cov) | | US7750123 SEQ ID NO: 20; WO2005060520; CN1914226; US20050249739 | 6779 |
| CORV44 | Light chain variable region, SARS antibody | s110.4 | US20110159001 SEQ ID NO: 64; WO2009128963; EP2242768; CN102015767 | 6780 |
| CORV45 | Light chain variable region, SARS antibody | s124.5 | US20110159001 SEQ ID NO: 68; WO2009128963; EP2242768; CN102015767 | 6781 |
| CORV46 | Light chain variable region, SARS antibody | s215.17 | US20110159001 SEQ ID NO: 72; WO2009128963; EP2242768; CN102015767 | 6782 |
| CORV47 | Light chain variable region, SARS antibody | s218.9 | US20110159001 SEQ ID NO: 76; WO2009128963; EP2242768; CN102015767 | 6783 |
| CORV48 | Light chain variable region, SARS antibody | s223.4 | US20110159001 SEQ ID NO: 80; WO2009128963; EP2242768; CN102015767 | 6784 |
| CORV49 | Light chain variable region, SARS antibody | s225.1.2 | US20110159001 SEQ ID NO: 84; WO2009128963; EP2242768; CN102015767 | 6785 |
| CORV50 | Light chain variable region, SARS antibody | s231.19 | US20110159001 SEQ ID NO: 88; WO2009128963; EP2242768; CN102015767 | 6786 |
| CORV51 | Light chain variable region, SARS antibody | s230.14 + 15 | US20110159001 SEQ ID NO: 92; WO2009128963; EP2242768; CN102015767 | 6787 |
| CORV52 | Light chain variable region, SARS antibody | s227.14 | US20110159001 SEQ ID NO: 96; WO2009128963; EP2242768; CN102015767 | 6788 |
| CORV53 | Light chain variable region, SARS antibody | s109.8 | US20110159001 SEQ ID NO: 101; WO2009128963; EP2242768; CN102015767 | 6789 |
| CORV54 | Light chain variable region, SARS antibody | Fab58 | CN1513874 | 6790 |
| CORV55 | Light chain variable region, SARS antibody | Fab59 | CN1513874 | 6791 |
| CORN56 | Light chain variable region, SARS human monoclonal antibody | 3C7 | US7728110 SEQ ID NO: 58; WO2008060331; EP2035454A2, US20080248043 | 6792 |

TABLE 25-continued

Antibodies against Coronaviruses

| Antibody No. | Description | Antibody Name | Reference Information | SEQ ID NO |
|---|---|---|---|---|
| CORV57 | Light chain variable region, SARS human monoclonal antibody | F26G18 | US7622112 SEQ ID NO: 14; WO2005054469; US20080248043; US20080081047 | 6793 |
| CORV58 | Light chain, Humanized neutralizing murine monoclonal MERS | | CN103864924 SEQ ID NO: 4 | 6794 |
| CORV59 | Light chain, MERS | m336 | WO2015057942 SEQ ID NO: 2 | 6795 |
| CORV60 | Light chain, MERS | m337 | WO2015057942 SEQ ID NO: 10 | 6796 |
| CORV61 | Light chain, MERS | m338 | WO2015057942 SEQ ID NO: 17 | 6797 |
| CORV62 | Light chain, MERS | 2E 6 | CN104447986 SEQ ID NO: 4 | 6798 |
| CORV63 | Light chain, MERS | M336 | Ying et al., Nat Commun 6, 8223 (2015), NCBI Accession # 4XAK_L (214aa) | 6799 |
| CORV64 | Variable heavy chain-constant heavy chain 1, Humanized neutralizing murine monoclonal MERS | 4C2Fab | CN103864924 SEQ ID NO: 7 | 6800 |
| CORV65 | Variable light chain-constant light chain 1, Humanized neutralizing murine monoclonal MERS | 4C2Fab | CN103864924 SEQ ID NO: 9 | 6801 |

In one embodiment, the payload region of the AAV particle comprises one or more nucleic acid sequences, fragment or variants thereof or encodes one or more polypeptides, fragments or variants thereof described in U.S. Pat. No. 7,629,443, US Publication No US20080254440, Chinese Publication No. CN103613666. CN1570638, CN101522208, CN1673231, CN1590409, CN1557838, and CN1488645, the contents of each of which are herein incorporated by reference in their entirety, against SARS.

In one embodiment, the payload region of the AAV particle comprises one or more nucleic acid sequences encoding one or more of the payload antibody polypeptides listed in Table 26 against John Cunningham Virus.

TABLE 26

Antibodies against John Cunningham Virus

| Antibody No. | Description | Antibody Name | Reference Information | SEQ ID NO |
|---|---|---|---|---|
| JCV1 | Heavy chain | 14G8 | US20150056188 SEQ ID NO: 1 | 6802 |
| JCV2 | Heavy chain | 16H5 | US20150056188 SEQ ID NO: 5 | 6803 |
| JCV3 | Heavy chain | 18C9 | US20150056188 SEQ ID NO: 9 | 6804 |
| JCV4 | Heavy chain | 34C6 | US20150056188 SEQ ID NO: 13 | 6805 |
| JCV5 | Heavy chain | 18C9 N55S | US20150056188 SEQ ID NO: 16 | 6806 |
| JCV6 | Heavy chain | 18C9 N55Q | US20150056188 SEQ ID NO: 18 | 6807 |
| JCV7 | Heavy chain | 18C9 N55D | US20150056188 SEQ ID NO: 20 | 6808 |
| JCV8 | Heavy chain | 18C9 N55H | US20150056188 SEQ ID NO: 22 | 6809 |
| JCV9 | Heavy chain | 18C9 N55T | US20150056188 SEQ ID NO: 24 | 6810 |
| JCV10 | Heavy chain | 18C9 N55A | US20150056188 SEQ ID NO: 26 | 6811 |
| JCV11 | Heavy chain | 18C9 N55L | US20150056188 SEQ ID NO: 28 | 6812 |
| JCV12 | Heavy chain | 18C9 N55X | US20150056188 SEQ ID NO: 30 | 6813 |

TABLE 26-continued

Antibodies against John Cunningham Virus

| Antibody No. | Description | Antibody Name | Reference Information | SEQ ID NO |
|---|---|---|---|---|
| JCV13 | Heavy chain | 18C9 G56A | US20150056188 SEQ ID NO: 32 | 6814 |
| JCV14 | Heavy chain | 18C9 G56V | US20150056188 SEQ ID NO: 34 | 6815 |
| JCV15 | Heavy chain | 18C9 G56P | US20150056188 SEQ ID NO: 36 | 6816 |
| JCV16 | Heavy chain | 18C9 G56X | US20150056188 SEQ ID NO: 38 | 6817 |
| JCV17 | Heavy chain | 399-h (C35A V50A) | US20150050271 SEQ ID NO: 20 | 6818 |
| JCV18 | Heavy chain | Antibody from US20150050271 | US20150050271 SEQ ID NO: 66 | 6819 |
| JCV19 | Heavy chain | H0 | US20150050271 SEQ ID NO: 51 | 6820 |
| JCV20 | Heavy chain | H1 | US20150050271 SEQ ID NO: 52 | 6821 |
| JCV21 | Heavy chain | H3 | US20150050271 SEQ ID NO: 54 | 6822 |
| JCV22 | Heavy chain | H4 | US20150050271 SEQ ID NO: 55 | 6823 |
| JCV23 | Heavy chain | H5 | US20150050271 SEQ ID NO: 56 | 6824 |
| JCV24 | Heavy chain | H6 | US20150050271 SEQ ID NO: 57 | 6825 |
| JCV25 | Heavy chain | H7 | US20150050271 SEQ ID NO: 58 | 6826 |
| JCV26 | Heavy chain | H8 | US20150050271 SEQ ID NO: 59 | 6827 |
| JCV27 | Heavy chain | H9 | US20150050271 SEQ ID NO: 60 | 6828 |
| JCV28 | Heavy chain | L0 | US20150050271 SEQ ID NO: 48 | 6829 |
| JCV29 | Heavy chain | jcv411_vh | US20150050271 SEQ ID NO: 43 | 6830 |
| JCV30 | Heavy chain | IGHV3-30-3x01 | US20150050271 SEQ ID NO: 44 | 6831 |
| JCV31 | Heavy chain | H0 | US20150050271 SEQ ID NO: 19 | 6832 |
| JCV32 | Heavy chain | H0 V50G | US20150050271 SEQ ID NO: 21 | 6833 |

TABLE 26-continued

Antibodies against John Cunningham Virus

| Antibody No. | Description | Antibody Name | Reference Information | SEQ ID NO |
|---|---|---|---|---|
| JCV33 | Heavy chain | H1 | US20150050271 SEQ ID NO: 22 | 6834 |
| JCV34 | Heavy chain | H2 | US20150050271 SEQ ID NO: 23 | 6835 |
| JCV35 | Heavy chain | H3 | US20150050271 SEQ ID NO: 24 | 6836 |
| JCV36 | Heavy chain | H4 | US20150050271 SEQ ID NO: 25 | 6837 |
| JCV37 | Heavy chain | H5 | US20150050271 SEQ ID NO: 26 | 6838 |
| JCV38 | Heavy chain | H6 | US20150050271 SEQ ID NO: 27 | 6839 |
| JCV39 | Heavy chain | H7 | US20150050271 SEQ ID NO: 28 | 6840 |
| JCV40 | Heavy chain | H8 | US20150050271 SEQ ID NO: 29 | 6841 |
| JCV41 | Heavy chain | H9 | US20150050271 SEQ ID NO: 30 | 6842 |
| JCV42 | Heavy chain variable region | GRE1 | US20150191530 SEQ ID NO: 1 | 6843 |
| JCV43 | Heavy chain variable region | R399 | US20150050271 SEQ ID NO: 6 | 6844 |
| JCV44 | Light chain | 14G8 | US20150056188 SEQ ID NO: 3 | 6845 |
| JCV45 | Light chain | 16H5 | US20150056188 SEQ ID NO: 7 | 6846 |
| JCV46 | Light chain | 18C9 | US20150056188 SEQ ID NO: 11 | 6847 |
| JCV47 | Light chain | 34C6 | US20150056188 SEQ ID NO: 14 | 6848 |
| JCV48 | Light chain | 18C9 C96L | US20150056188 SEQ ID NO: 40 | 6849 |
| JCV49 | Light chain | 18C9 C96S | US20150056188 SEQ ID NO: 42 | 6850 |
| JCV50 | Light chain | 18C9 C96A | US20150056188 SEQ ID NO: 44 | 6851 |
| JCV51 | Light chain | 18C9 C96X | US20150056188 SEQ ID NO: 46 | 6852 |
| JCV52 | Light chain | 399-1 (N31G), L | US20150050271 SEQ ID NO: 15 | 6853 |
| JCV53 | Light chain | Antibody from US20150050271 | US20150050271 SEQ ID NO: 67 | 6854 |
| JCV54 | Light chain | H2 | US20150050271 SEQ ID NO: 53 | 6855 |
| JCV55 | Light chain | L1 | US20150050271 SEQ ID NO: 49 | 6856 |
| JCV56 | Light chain | L2 | US20150050271 SEQ ID NO: 50 | 6857 |
| JCV57 | Light chain | 1GKV1D-13x01 | US20150050271 SEQ ID NO: 39 | 6858 |
| JCV58 | Light chain | L0 | US20150050271 SEQ ID NO: 11 | 6859 |
| JCV59 | Light chain | L1 | US20150050271 SEQ ID NO: 12 | 6860 |
| JCV60 | Light chain | L2 | US20150050271 SEQ ID NO: 13 | 6861 |
| JCV61 | Light chain | L2 N31A | US20150050271 SEQ ID NO: 14 | 6862 |
| JCV62 | Heavy chain variable region | GRE1 | US20150191530 SEQ ID NO: 2 | 6863 |
| JCV63 | Heavy chain variable region | R399 | US20150050271 SEQ ID NO: 1 | 6864 |
| JCV64 | Heavy chain variable region | R411.jcv411_vh | US20150050271 SEQ ID NO: 38 | 6865 |

In one embodiment, the payload region of the AAV particle comprises one or more nucleic acid sequences encoding one or more of the payload antibody polypeptides listed in Table 27 against Poxvirus.

TABLE 27

Antibodies against Poxvirus

| Antibody No. | Description | Antibody Name | Reference Information | SEQ ID NO |
|---|---|---|---|---|
| POXV1 | Heavy chain variable region, B5R envelope protein | B5R binding antibody | US8623370 SEQ ID NO: 2 | 6866 |
| POXV2 | Heavy chain variable region, B5R envelope protein | B5R binding antibody | US8623370 SEQ ID NO: 6 | 6867 |
| POXV3 | Heavy chain variable region, B5R envelope protein | B5R binding antibody | US8623370 SEQ ID NO: 10 | 6868 |
| POXV4 | Heavy chain variable region, B5R envelope protein | B5R binding antibody | US8623370 SEQ ID NO: 14 | 6869 |
| POXV5 | Heavy chain, H3L envelope protein | H3L binding antibody | US20140186370 SEQ ID NO: 14 | 6870 |
| POXV6 | Light chain variable region, B5R envelope protein | B5R binding antibody | US8623370 SEQ ID NO: 4 | 6871 |
| POXV7 | Light chain variable region, B5R envelope protein | B5R binding antibody | US8623370 SEQ ID NO: 8 | 6872 |
| POXV8 | Light chain variable region, B5R envelope protein | B5R binding antibody | US8623370 SEQ ID NO: 12 | 6873 |
| POXV9 | Light chain variable region, B5R envelope protein | B5R binding antibody | US8623370 SEQ ID NO: 16 | 6874 |
| POXV10 | Light chain, H3L envelope protein | H3L binding antibody | US20140186370 SEQ ID NO: 16 | 6875 |

In one embodiment, the payload region of the AAV particle comprises one or more nucleic acid sequences encoding one or more of the payload antibody polypeptides listed in Table 28 against Enterovirus 71.

TABLE 28

Antibodies against Enterovirus 71

| Antibody No. | Description | Antibody Name | Reference Information | SEQ ID NO |
|---|---|---|---|---|
| ENTV1 | Heavy chain variable region | | CN102718864A SEQ ID NO: 2 | 6876 |
| ENTV2 | Heavy chain variable region | E18 | WO2015092668 SEQ ID NO: 1 | 6877 |
| ENTV3 | Heavy chain variable region | E19 | WO2015092668 SEQ ID NO: 3 | 6878 |
| ENTV4 | Heavy chain variable region | E20 | WO2015092668 SEQ ID NO: 5 | 6879 |
| ENTV5 | Heavy chain variable region | E19 humanized VH1 | WO2015092668 SEQ ID NO: 19 | 6880 |
| ENTV6 | Heavy chain variable region | E19 humanized VH2 | WO2015092668 SEQ ID NO: 20 | 6881 |
| ENTV7 | Heavy chain variable region | E19 humanized VH3 | WO2015092668 SEQ ID NO: 21 | 6882 |
| ENTV8 | Heavy chain variable region | E19 humanized VH4 | WO2015092668 SEQ ID NO: 22 | 6883 |
| ENTV9 | Light chain variable region | | CN102718864A SEQ ID NO: 1 | 6884 |
| ENTV10 | Light chain variable region | E18 | WO2015092668 SEQ ID NO: 2 | 6885 |

TABLE 28-continued

Antibodies against Enterovirus 71

| Antibody No. | Description | Antibody Name | Reference Information | SEQ ID NO |
|---|---|---|---|---|
| ENTV11 | Light chain variable region | E19 | WO2015092668 SEQ ID NO: 4 | 6886 |
| ENTV12 | Light chain variable region | E20 | WO2015092668 SEQ ID NO: 6 | 6887 |
| ENTV13 | Light chain variable region | E18 VL2 | WO2015092668 SEQ ID NO: 15 | 6888 |
| ENTV14 | Light chain variable region | E19 humanized VL1 | WO2015092668 SEQ ID NO: 16 | 6889 |
| ENTV15 | Light chain variable region | E19 humanized VL2 | WO2015092668 SEQ ID NO: 17 | 6890 |
| ENTV16 | Light chain variable region | E19 humanized VL3 | WO2015092668 SEQ ID NO: 18 | 6891 |

In one embodiment, the payload region of the AA particle comprises one or more nucleic acid sequences, fragment or variants thereof or encodes one or more polypeptides, fragments or variants thereof described in Chinese Publication No. CN104357400, the contents of which are herein incorporated by reference in their entirety, against EV71.

In one embodiment, the payload region of the AAV particle comprises one or more nucleic acid sequences, fragment or variants encoding MAB979, fragments or variants thereof for treating a disease and/or disorder or preventing a disease and/or disorder. As a non-limiting example, the disease and/or disorder is EV71.

In one embodiment, the payload region of the AAV particle comprises one or more nucleic acid sequences encoding one or more of the payload antibody polypeptides listed in Table 29 against Rubella Virus.

TABLE 29

Antibodies against Rubella Virus

| Antibody No. | Description | Antibody Name | Reference Information | SEQ ID NO |
|---|---|---|---|---|
| RUBV1 | Heavy chain variable region | DDF-RuV1 | US20100143376 SEQ ID NO: 2 | 6892 |
| RUBV2 | Heavy chain variable region | DDF-RuV2 | US20100143376 SEQ ID NO: 9 | 6893 |
| RUBV3 | Light chain variable region | DDF-RuV1 | US20100143376 SEQ ID NO: 7 | 6894 |
| RUBV4 | Light chain variable region | DDF-RuV2 | US20100143376 SEQ ID NO: 14 | 6895 |

In one embodiment, the payload region of the AAV particle comprises one or more nucleic acid sequences encoding one or more of the payload antibody polypeptides listed in Table 30 against Human Papilloma Virus.

TABLE 30

Antibodies against Human Papilloma Virus

| Antibody No. | Description | Reference Information | SEQ ID NO |
|---|---|---|---|
| HPV1 | Heavy chain variable region | WO2015096269 SEQ ID NO: 1 | 6896 |
| HPV2 | Light chain variable region | WO2015096269 SEQ ID NO: 2 | 6897 |

In one embodiment, the payload region of the AAV particle comprises one or more nucleic acid sequences, fragment or variants thereof or encodes one or more polypeptides, fragments or variants thereof described in US Publication No. US20130337438, the contents of which are herein incorporated by reference in their entirety, against HBV.

In one embodiment, the payload region of the AAV particle comprises one or more nucleic acid sequences encoding one or more of the broadly neutralizing payload antibody polypeptides listed in Table 31 against viruses.

TABLE 31

Broadly Neutralizing Antibodies for Viruses

| Antibody No. | Description | Antibody Name | Reference Information | SEQ ID NO |
|---|---|---|---|---|
| VIR1 | Heavy chain variable region, hepatitis, influenza, HIV, herpes, paramyxovirus, poxvirus, rhabdovirus or arenavirus | 3G4 | US7611704 SEQ ID NO: 2 | 6898 |
| VIR2 | Heavy chain variable region, hepatitis, influenza, HIV, herpes, paramyxovirus, poxvirus, rhabdovirus or arenavirus | 3G4 | US7611704 SEQ ID NO: 4 | 6899 |
| VIR3 | Heavy chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, light chain variable region, Dengue, rubella, measles, adenovirus, human T-cell leukemias, Epstein-Barr, murine leukemia, mumps, vesicular stomatitis, Sindbis, lymphocytic choriomeningitis, wart and blue tongue | 679 | US7429381 SEQ ID NO: 4 | 6900 |
| VIR4 | Heavy chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, adenovirus, human T-cell leukemias, Epstein-Barr, murine leukemia, mumps, vesicular stomatitis, Sindbis, lymphocytic choriomeningitis, wart and blue tongue, light chain variable region | Mu-9V | US7429381 SEQ ID NO: 10 | 6901 |
| VIR5 | Heavy chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, | humanized Mu-9 | US7429381 SEQ ID NO: 14 | 6902 |

TABLE 31-continued

Broadly Neutralizing Antibodies for Viruses

| Antibody No. | Description | Antibody Name | Reference Information | SEQ ID NO |
|---|---|---|---|---|
| | adenovirus, human T-cell leukemias, Epstein-Barr, murine leukemia, mumps, vesicular stomatitis, Sindbis, lymphocytic choriomeningitis, wart and blue tongue, light chain variable region | | | |
| VIR6 | Heavy chain variable region, Human cytomegalovirus, HCMV, human T-cell leukemia virus type 1, HIV-1, simian immunodeficiency virus, Ebola virus, Herpesvirus saimiri virus, influenza virus, and vaccinia virus | Fab-2 Clone3 | US20120269801 SEQ ID NO: 6 | 6903 |
| VIR7 | Heavy chain variable region, Human cytomegalovirus, HCMV, human T-cell leukemia virus type 1, HIV-1, simian immunodeficiency virus, Ebola virus, Herpesvirus saimiri virus, influenza virus, and vaccinia virus | Fab-3 Clone 7 | US20120269801 SEQ ID NO: 10 | 6904 |
| VIR8 | Light chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, adenovirus, human T-cell leukemias, Epstein-Bair, murine leukemia, mumps, vesicular stomatitis, Sindbis, lymphocytic choriomeningitis, wart and blue tongue, light chain variable region | Mu-9V | US7429381 SEQ ID NO: 8 | 6905 |
| VIR9 | Light chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, adenovirus, human T-cell leukemias, Epstein-Barr, murine leukemia, mumps, vesicular stomatitis, Sindbis, lymphocytic choriomeningitis, wart and blue tongue, light chain variable region | humanized Mu-9 | US7429381 SEQ ID NO: 12 | 6906 |
| VIR10 | Light chain variable region, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, adenovirus, human T-cell leukemias, Epstein-Barr, murine leukemia, mumps, vesicular stomatitis, Sindbis, lymphocytic choriomeningitis, wart and blue tongue | 679 | US7429381 SEQ ID NO: 2 | 6907 |
| VIR11 | Light chain variable region, Human cytomegalovirus, HCMV, human T-cell leukemia virus type 1, HIV-1, simian immunodeficiency virus, Ebola virus, Herpesvirus saimiri virus, influenza virus, and vaccinia virus | Fab-3 Clone 7 | US20120269801 SEQ ID NO: 8 | 6908 |
| VIR12 | Light chain variable, Human cytomegalovirus, HCMV, human T-cell leukemia virus type 1, HIV-1, simian immunodeficiency virus, Ebola virus, Herpesvirus saimiri virus, influenza virus, and vaccinia virus, region | Fab-2 Clone3 | US20120269801 SEQ ID NO: 4 | 6909 |
| VIR13 | ScFv, hepatitis, influenza, HIV, herpes, paramyxovirus, poxvirus, rhabdovirus or arenavirus | 3A2 | US7611704 SEQ ID NO: 6 | 6910 |
| VIR14 | ScFv, HIV, herpes, cytomegalovirus, rabies, influenza, hepatitis B, Sendai, feline leukemia, Reo, polio, human serum parvo-like, simian 40, respiratory syncytial, mouse mammary tumor, Varicella-Zoster, Dengue, rubella, measles, adenovirus, human T-cell leukemias, Epstein-Barr, murine leukemia, mumps, vesicular stomatitis, Sindbis, lymphocytic choriomeningitis, wart and blue tongue | 679 | US7429381 SEQ ID NO: 6 | 6911 |

In one embodiment, the payload region of the AAV particle comprises one or more nucleic acid sequences encoding one or more of the payload antibody polypeptides listed in Table 32 against *Pseudomonas aeruginosa*

TABLE 32

Antibodies against *Pseudomonas Aeruginosa*

| Antibody No. | Description | Antibody Name | Reference Information | SEQ ID NO |
|---|---|---|---|---|
| PSEU1 | Bivalent nanobody | 260 (1E11-40GS-2B10) | US20150044215 SEQ ID NO: 118 | 6912 |
| PSEU2 | Bivalent nanobody | 272 (11B09-40GS-10C05) | US20150044215 SEQ ID NO: 119 | 6913 |
| PSEU3 | Bivalent nanobody | 308 (6B05-40GS-1E11) | US20150044215 SEQ ID NO: 120 | 6914 |
| PSEU4 | Bivalent nanobody | 264 (1E11-40GS-2B02) | US20150044215 SEQ ID NO: 121 | 6915 |
| PSEU5 | Bivalent nanobody | 302 (5H01-40GS-7C10) | US20150044215 SEQ ID NO: 122 | 6916 |
| PSEU6 | Bivalent nanobody | 234 (7C10-40GS-5H01) | US20150044215 SEQ ID NO: 123 | 6917 |
| PSEU7 | Bivalent nanobody | 064 (13F07-40GS-7C10) | US20150044215 SEQ ID NO: 124 | 6918 |
| PSEU8 | Bivalent nanobody | 275 (2G09-40GC-5H10) | US20150044215 SEQ ID NO: 125 | 6919 |
| PSEU9 | Bivalent nanobody | 083 (7C10-40GS-11B09) | US20150044215 SEQ ID NO: 126 | 6920 |
| PSEU10 | Bivalent nanobody | 087 (1E11-40GS-7C10) | US20150044215 SEQ ID NO: 127 | 6921 |
| PSEU11 | Bivalent nanobody | 269 (6B05-40GS-13F07) | US20150044215 SEQ ID NO: 128 | 6922 |
| PSEU12 | Bivalent nanobody | 256 (13F07-40GS-5H01) | US20150044215 SEQ ID NO: 129 | 6923 |
| PSEU13 | Bivalent nanobody | 277 (5H01-40GS-11B09) | US20150044215 SEQ ID NO: 130 | 6924 |
| PSEU14 | Bivalent nanobody | 257 (13F07-40GS-2B10) | US20150044215 SEQ ID NO: 131 | 6925 |
| PSEU15 | Bivalent nanobody | 285 (13F07-40GS-2B02) | US20150044215 SEQ ID NO: 132 | 6926 |
| PSEU16 | Bivalent nanobody | 115 (11B09-40GS-13F07) | US20150044215 SEQ ID NO: 133 | 6927 |
| PSEU17 | Bivalent nanobody | 258 (13F07-40GS-14E10) | US20150044215 SEQ ID NO: 134 | 6928 |
| PSEU18 | Bivalent nanobody | 283 (7E09-40G5-6B05) | US20150044215 SEQ ID NO: 135 | 6929 |
| PSEU19 | Bivalent nanobody | 271 (7C10-40GS-14E10) | US20150044215 SEQ ID NO: 136 | 6930 |
| PSEU20 | Bivalent nanobody | 259 (1E11-40GS-5H01) | US20150044215 SEQ ID NO: 137 | 6931 |
| PSEU21 | Bivalent nanobody | 319 (13F07-40GS-6B05) | US20150044215 SEQ ID NO: 138 | 6932 |
| PSEU22 | Bivalent nanobody | 335 (5H01-40G5-1E11) | US20150044215 SEQ ID NO: 139 | 6933 |
| PSEU23 | Bivalent nanobody | 261 (5H01-40GS-2B10) | US20150044215 SEQ ID NO: 140 | 6934 |
| PSEU24 | Bivalent nanobody | 262 (7E09-40GS-7C10) | US20150044215 SEQ ID NO: 141 | 6935 |
| PSEU25 | Constant heavy chain | | US20150044215 SEQ ID NO: 148 | 6936 |
| PSEU26 | Constant light chain | | US20150044215 SEQ ID NO: 149 | 6937 |
| PSEU27 | Heavy chain | Panobacumab | US8197816 SEQ ID NO: 8 | 6938 |
| PSEU28 | Heavy chain | | US20130156696 SEQ ID NO: 2 | 6939 |
| PSEU29 | Heavy chain | | US7494653 SEQ ID NO: 2 | 6940 |
| PSEU30 | Heavy chain variable region | KB0001 | US8044181 SEQ ID NO: 3 | 6941 |
| PSEU31 | Heavy chain variable region | KB0001 | US8044181 SEQ ID NO: 5 | 6942 |
| PSEU32 | Heavy chain variable region | KB0001 | US8044181 SEQ ID NO: 7 | 6943 |
| PSEU33 | Heavy chain variable region | KB0001 | US8044181 SEQ ID NO: 9 | 6944 |
| PSEU34 | Heavy chain variable region | KB0001 | US8044181 SEQ ID NO: 11 | 6945 |
| PSEU35 | Heavy chain variable region | 1F3 | US9085611 SEQ ID NO: 11 | 6946 |
| PSEU36 | Heavy chain variable region | 2A4 | US9085611 SEQ ID NO: 13 | 6947 |
| PSEU37 | Heavy chain variable region | | US9085611 SEQ ID NO: 27 | 6948 |
| PSEU38 | Heavy chain variable region | mAbs LST-001 | US8653242 SEQ ID NO: 29 | 6949 |
| PSEU39 | Heavy chain variable region | rnAbs LST-002 | US8653242 SEQ ID NO: 49 | 6950 |
| PSEU40 | Heavy chain variable region | mAbs LST-005 | US8653242 SEQ ID NO: 52 | 6951 |
| PSEU41 | Heavy chain variable region | rnAbs LST-006 | US8653242 SEQ ID NO: 54 | 6952 |
| PSEU42 | Heavy chain variable region | mAbs LST-007 | US8653242 SEQ ID NO: 13 | 6953 |
| PSEU43 | Heavy chain variable region | mAbs LST-008 | US8653242 SEQ ID NO: 15 | 6954 |
| PSEU44 | Heavy chain variable region | 310BO6 | US7597893 SEQ ID NO: 8 | 6955 |
| PSEU45 | Heavy chain variable region | Cam-003 | US20140227285 SEQ ID NO: 1 | 6956 |
| PSEU46 | Heavy chain variable region | Cam-004 | US20140227285 SEQ ID NO: 3 | 6957 |
| PSEU47 | Heavy chain variable region | Cam-005 | US20140227285 SEQ ID NO: 4 | 6958 |
| PSEU48 | Heavy chain variable region | WapR-001 | US20140227285 SEQ ID NO: 5 | 6959 |
| PSEU49 | Heavy chain variable region | WapR-002 | US20140227285 SEQ ID NO: 7 | 6960 |
| PSEU50 | Heavy chain variable region | WapR-003 | US20140227285 SEQ ID NO: 9 | 6961 |
| PSEU51 | Heavy chain variable region | WapR-004 | US20140227285 SEQ ID NO: 11 | 6962 |
| PSEU52 | Heavy chain variable region | WapR-007 | US20140227285 SEQ ID NO: 13 | 6963 |
| PSEU53 | Heavy chain variable region | WapR-016 | US20140227285 SEQ ID NO: 15 | 6964 |
| PSEU54 | Heavy chain variable region | 1584 | US20130045207 SEQ ID NO: 8 | 6965 |
| PSEU55 | Heavy chain variable region | 1573 | US20130045207 SEQ ID NO: 16 | 6966 |
| PSEU56 | Heavy chain variable region | 1572 | US20130045207 SEQ ID NO: 24 | 6967 |
| PSEU57 | Heavy chain variable region | 1587 | US20130045207 SEQ ID NO: 32 | 6968 |
| PSEU58 | Heavy chain variable region | 3099 | US20130022604 SEQ ID NO: 8 | 6969 |

TABLE 32-continued

Antibodies against *Pseudomonas Aeruginosa*

| Antibody No. | Description | Antibody Name | Reference Information | SEQ ID NO |
|---|---|---|---|---|
| PSEU59 | Heavy chain variable region | 2745 | US20130022604 SEQ ID NO: 16 | 6970 |
| PSEU60 | Heavy chain variable region | 2459 | US20130022604 SEQ ID NO: 24 | 6971 |
| PSEU61 | Heavy chain variable region | 2316 | US20130022606 SEQ ID NO: 8 | 6972 |
| PSEU62 | Heavy chain variable region | 1838 | US20130022606 SEQ ID NO: 16 | 6973 |
| PSEU63 | Heavy chain variable region | 2314 | US20130022606 SEQ ID NO: 24 | 6974 |
| PSEU64 | Heavy chain variable region | 2326 | US20130022606 SEQ ID NO: 32 | 6975 |
| PSEU65 | Heavy chain variable region | 2328 | US20130022606 SEQ ID NO: 40 | 6976 |
| PSEU66 | Heavy chain variable region | 2438 | US20130022606 SEQ ID NO: 48 | 6977 |
| PSEU67 | Heavy chain variable region | 1774 | US20130004500 SEQ ID NO: 8 | 6978 |
| PSEU68 | Heavy chain variable region | 1660 | US20130004500 SEQ ID NO: 16 | 6979 |
| PSEU69 | Heavy chain variable region | 1923 | US20130004500 SEQ ID NO: 24 | 6980 |
| PSEU70 | Heavy chain variable region | 1656 | US20130004499 SEQ ID NO: 8 | 6981 |
| PSEU71 | Heavy chain variable region | 1640 | US20130004499 SEQ ID NO: 16 | 6982 |
| PSEU72 | Heavy chain variable region | 2459 | US20130004499 SEQ ID NO: 24 | 6983 |
| PSEU73 | Heavy chain variable region | | US20120114657 SEQ ID NO: 8 | 6984 |
| PSEU74 | Heavy chain variable region | Anti-It-2 | US20110177087 SEQ ID NO: 13 | 6985 |
| PSEU75 | Heavy chain variable region | Anti-It-3 | US20110177087 SEQ ID NO: 14 | 6986 |
| PSEU76 | Heavy chain variable region | Anti-It-4 | US20110177087 SEQ ID NO: 15 | 6987 |
| PSEU77 | Heavy chain variable region | Anti-It-5 | US20110177087 SEQ ID NO: 16 | 6988 |
| PSEU78 | Heavy chain variable region | Anti-It-6 | US20110177087 SEQ ID NO: 17 | 6989 |
| PSEU79 | Heavy chain variable region | Anti-170003 | US20110177087 SEQ ID NO: 18 | 6990 |
| PSEU80 | Heavy chain variable region | Anti-170006 | US20110177087 SEQ ID NO: 19 | 6991 |
| PSEU81 | Heavy chain variable region | Anti-Pa01 | US20110177087 SEQ ID NO: 20 | 6992 |
| PSEU82 | Heavy chain variable region | Anti-IATS016 | US20110177087 SEQ ID NO: 21 | 6993 |
| PSEU83 | Heavy chain variable region | | US20090191186 SEQ ID NO: 1 | 6994 |
| PSEU84 | Heavy chain variable region | | US20090191186 SEQ ID NO: 11 | 6995 |
| PSEU85 | Heavy chain variable region | | US20090191186 SEQ ID NO: 3 | 6996 |
| PSEU86 | Heavy chain variable region | | US20090191186 SEQ ID NO: 7 | 6997 |
| PSEU87 | Heavy chain variable region | | US20090191186 SEQ ID NO: 9 | 6998 |
| PSEU88 | Heavy chain variable region | | US20090191186 SEQ ID NO: 5 | 6999 |
| PSEU89 | Heavy chain variable region | | US20090191186 SEQ ID NO: 13 | 7000 |
| PSEU90 | Heavy chain variable region | | US20090191186 SEQ ID NO: 21 | 7001 |
| PSEU91 | Heavy chain variable region | | US20090191186 SEQ ID NO: 17 | 7002 |
| PSEU92 | Heavy chain variable region | | US20090191186 SEQ ID NO: 26 | 7003 |
| PSEU93 | Heavy chain variable region | | US20090191186 SEQ ID NO: 25 | 7004 |
| PSEU94 | Heavy chain variable region | | US20090191186 SEQ ID NO: 23 | 7005 |
| PSEU95 | Heavy chain variable region | | US20090191186 SEQ ID NO: 29 | 7006 |
| PSEU96 | Heavy chain variable region | | US20090191186 SEQ ID NO: 35 | 7007 |
| PSEU97 | Heavy chain variable region | V2L2 | WO2014074528 SEQ ID NO: 216 | 7008 |
| PSEU98 | Heavy chain variable region | V2L2-MD | WO2014074528 SEQ ID NO: 255 | 7009 |
| PSEU99 | Heavy chain variable region | V2L2-MD and V2L2-GL | WO2014074528 SEQ ID NO: 256 | 7010 |
| PSEU100 | Heavy chain variable region | V2L2-GL | WO2014074528 SEQ ID NO: 257 | 7011 |
| PSEU101 | Heavy chain variable region | 2409 | WO2013024905 SEQ ID NO: 16 | 7012 |
| PSEU102 | Heavy chain variable region | 2453 | WO2013024905 SEQ ID NO: 24 | 7013 |
| PSEU103 | Heavy chain variable region | S20 | US7972845 SEQ ID NO: 2 | 7014 |
| PSEU104 | Heavy chain variable region | Fab 13.37 | US20150044215 SEQ ID NO: 142 | 7015 |
| PSEU105 | Heavy chain variable region | Fab 26.24 | US20150044215 SEQ ID NO: 144 | 7016 |
| PSEU106 | Heavy chain variable region | Fab 35.36 | US20150044215 SEQ ID NO: 146 | 7017 |

TABLE 32-continued

Antibodies against *Pseudomonas Aeruginosa*

| Antibody No. | Description | Antibody Name | Reference Information | SEQ ID NO |
|---|---|---|---|---|
| PSEU107 | Heavy chain variable region | KB0001 | US8044181 SEQ ID NO: 1 | 7018 |
| PSEU108 | Heavy chain, LPS serotype IATS-O11. | | Horn., M.P. et al. "Preclinical In Vitro and In Vivo characterization of the fully human monoclonal IgM antibody KBPA101 specific for *Pseudomonas aeruginosa* serotype IATS-O11", Antimicrob. Agents Chemother. 54 (6), 2338-2344 (2010) | 7019 |
| PSEU109 | J chain | Panobacumab | | 7020 |
| PSEU110 | Light chain | Panobacumab | US8197816 SEQ ID NO: 7 | 7021 |
| PSEU111 | Light chain | | US20130156696 SEQ ID NO: 4 | 7022 |
| PSEU112 | Light chain | | US7494653 SEQ ID NO: 4 | 7023 |
| PSEU113 | Light chain variable region | 1F3 | US9085611 SEQ ID NO: 2 | 7024 |
| PSEU114 | Light chain variable region | 2A4 | US9085611 SEQ ID NO: 4 | 7025 |
| PSEU115 | Light chain variable region | | US9085611 SEQ ID NO: 28 | 7026 |
| PSEU116 | Light chain variable region | mAbS LST-001 | US8653242 SEQ ID NO: 18 | 7027 |
| PSEU117 | Light chain variable region | mAbs LST-006 | US8653242 SEQ ID NO: 53 | 7028 |
| PSEU118 | Light chain variable region | mAbs LST-008 | US8653242 SEQ ID NO: 14 | 7029 |
| PSEU119 | Light chain variable region | mAbs LST-008 | US8653242 SEQ ID NO: 16 | 7030 |
| PSEU120 | Light chain variable region | 310BO6 | US7597893 SEQ ID NO: 7 | 7031 |
| PSEU121 | Light chain variable region | Cam-003, Cam-004, Cam-005 | US20140227285 SEQ ID NO: 2 | 7032 |
| PSEU122 | Light chain variable region | WapR-001 | US20140227285 SEQ ID NO: 6 | 7033 |
| PSEU123 | Light chain variable region | WapR-002 | US20140227285 SEQ ID NO: 8 | 7034 |
| PSEU124 | Light chain variable region | WapR-003 | US20140227285 SEQ ID NO: 10 | 7035 |
| PSEU125 | Light chain variable region | WapR-004, WapR-004-RAD | US20140227285 SEQ ID NO: 12 | 7036 |
| PSEU126 | Light chain variable region | WapR-007 | US20140227285 SEQ ID NO: 14 | 7037 |
| PSEU127 | Light chain variable region | WapR-016 | US20140227285 SEQ ID NO: 16 | 7038 |
| PSEU128 | Light chain variable region | 1584 | US20130045207 SEQ ID NO: 7 | 7039 |
| PSEU129 | Light chain variable region | 1573 | US20130045207 SEQ ID NO: 5 | 7040 |
| PSEU130 | Light chain variable region | 1572 | US20130045207 SEQ ID NO: 23 | 7041 |
| PSEU131 | Light chain variable region | 1587 | US20130045207 SEQ ID NO: 31 | 7042 |
| PSEU132 | Light chain variable region | 3099 | US20130022604 SEQ ID NO: 7 | 7043 |
| PSEU133 | Light chain variable region | 2745 | US20130022604 SEQ ID NO: 15 | 7044 |
| PSEU134 | Light chain variable region | 2459 | US20130022604 SEQ ID NO: 23 | 7045 |
| PSEU135 | Light chain variable region | 2316 | US20130022606 SEQ ID NO: 7 | 7046 |
| PSEU136 | Light chain variable region | 1838 | US20130022606 SEQ ID NO: 15 | 7047 |
| PSEU137 | Light chain variable region | 2314 | US20130022606 SEQ ID NO: 23 | 7048 |
| PSEU138 | Light chain variable region | 2326 | US20130022606 SEQ ID NO: 31 | 7049 |
| PSEU139 | Light chain variable region | 2328 | US20130022606 SEQ ID NO: 39 | 7050 |
| PSEU140 | Light chain variable region | 2438 | US20130022606 SEQ ID NO: 47 | 7051 |
| PSEU141 | Light chain variable region | 1774 | US20130004500 SEQ ID NO: 7 | 7052 |
| PSEU142 | Light chain variable region | 1660 | US20130004500 SEQ ID NO: 15 | 7053 |
| PSEU143 | Light chain variable region | 1923 | US20130004500 SEQ ID NO: 23 | 7054 |
| PSEU144 | Light chain variable region | 1656 | US20130004499 SEQ ID NO: 7 | 7055 |
| PSEU145 | Light chain variable region | 1640 | US20130004499 SEQ ID NO: 5 | 7056 |
| PSEU146 | Light chain variable region | 2459 | US20130004499 SEQ ID NO: 23 | 7057 |
| PSEU147 | Light chain variable region | | US20120114657 SEQ ID NO: 7 | 7058 |
| PSEU148 | Light chain variable region | Anti-It-2 | US20110177087 SEQ ID NO: 22 | 7059 |
| PSEU149 | Light chain variable region | Anti-It-3 | US20110177087 SEQ ID NO: 23 | 7060 |
| PSEU150 | Light chain variable region | Anti-It-4 | US20110177087 SEQ ID NO: 24 | 7061 |
| PSEU151 | Light chain variable region | Anti-It-5 | US20110177087 SEQ ID NO: 25 | 7062 |
| PSEU152 | Light chain variable region | Anti-It-6 | US20110177087 SEQ ID NO: 26 | 7063 |

TABLE 32-continued

Antibodies against *Pseudomonas Aeruginosa*

| Antibody No. | Description | Antibody Name | Reference Information | SEQ ID NO |
|---|---|---|---|---|
| PSEU153 | Light chain variable region | Anti-170003 | US20110177087 SEQ ID NO: 27 | 7064 |
| PSEU154 | Light chain variable region | Anti-170006 | US20110177087 SEQ ID NO: 28 | 7065 |
| PSEU155 | Light chain variable region | Anti-Pa01 | US20110177087 SEQ ID NO: 29 | 7066 |
| PSEU156 | Light chain variable region | Anti-IATS016 | US20110177087 SEQ ID NO: 30 | 7067 |
| PSEU157 | Light chain variable region | | US20090191186 SEQ ID NO: 2 | 7068 |
| PSEU158 | Light chain variable region | | US20090191186 SEQ ID NO: 12 | 7069 |
| PSEU159 | Light chain variable region | | US20090191186 SEQ ID NO: 8 | 7070 |
| PSEU160 | Light chain variable region | | US20090191186 SEQ ID NO: 10 | 7071 |
| PSEU161 | Light chain variable region | | US20090191186 SEQ ID NO: 6 | 7072 |
| PSEU162 | Light chain variable region | | US20090191186 SEQ ID NO: 37 | 7073 |
| PSEU163 | Light chain variable region | | US20090191186 SEQ ID NO: 18 | 7074 |
| PSEU164 | Light chain variable region | | US20090191186 SEQ ID NO: 24 | 7075 |
| PSEU165 | Light chain variable region | | US20090191186 SEQ ID NO: 20 | 7076 |
| PSEU166 | Light chain variable region | | US20090191186 SEQ ID NO: 36 | 7077 |
| PSEU167 | Light chain variable region | | US20090191186 SEQ ID NO: 28 | 7078 |
| PSEU168 | Light chain variable region | | US20090191186 SEQ ID NO: 30 | 7079 |
| PSEU169 | Light chain variable region | | US20090191186 SEQ ID NO: 34 | 7080 |
| PSEU170 | Light chain variable region | | US20090191186 SEQ ID NO: 32 | 7081 |
| PSEU171 | Light chain variable region | V2L2 | WO2014074528 SEQ ID NO: 217 | 7082 |
| PSEU172 | Light chain variable region | 2409 | WO2013024905 SEQ ID NO: 15 | 7083 |
| PSEU173 | Light chain variable region | 2453 | WO2013024905 SEQ ID NO: 23 | 7084 |
| PSEU174 | Light chain variable region | S20 | US7972845 SEQ ID NO: 4 | 7085 |
| PSEU175 | Light chain variable region | Fab 13.37 | US20150044215 SEQ ID NO: 143 | 7086 |
| PSEU176 | Light chain variable region | Fab 26.24 | US20150044215 SEQ ID NO: 45 | 7087 |
| PSEU177 | Light chain variable region | Fab 35.36 | US20150044215 SEQ ID NO: 147 | 7088 |
| PSEU178 | Light chain variable region majority | mAbs LST-002 | US8653242 SEQ ID NO: 32 | 7089 |
| PSEU179 | Light chain variable region majority | mAbs LST-006 | US8653242 SEQ ID NO: 55 | 7090 |
| PSEU180 | Light chain variable region minority | mAbs LST-002 | US8653242 SEQ ID NO: 51 | 7091 |
| PSEU181 | Light chain variable region minority | mAbs LST-007 | US8653242 SEQ ID NO: 56 | 7092 |
| PSEU182 | Light chain, Anti-P. Aeuginosa LPS serotype IATS-O11, | | Horn, M.P. et al. "Preclinical In Vitro and in Vivo characterization of the fully human monoclonal IgM antibody KBPA101 specific for *Pseudomonas aeruginosa* serotype IATS-O11", Antimicrob. Agents Chemother. 54 (6), 2338-2344 (2010) | 7093 |
| PSEU183 | Light kappa chain variable region | KB0001 | US8044181 SEQ ID NO: 10 | 7094 |
| PSEU184 | Light kappa chain variable region | KB0001 | US8044181 SEQ ID NO: 2 | 7095 |
| PSEU185 | Light kappa chain variable region | KB0001 | US8044181 SEQ ID NO: 4 | 7096 |
| PSEU186 | Light kappa chain variable region | KB0001 | US8044181 SEQ ID NO: 6 | 7097 |
| PSEU187 | Light kappa chain variable region | KB0001 | US8044181 SEQ ID NO: 8 | 7098 |
| PSEU188 | Monovalent nanobody | 5H01 | US20150044215 SEQ ID NO: 1 | 7099 |
| PSEU189 | Monovalent nanobody | 7C10 | US20150044215 SEQ ID NO: 2 | 7100 |
| PSEU190 | Monovalent nanobody | 1E11 | US20150044215 SEQ ID NO: 3 | 7101 |
| PSEU191 | Monovalent nanobody | 2B02 | US20150044215 SEQ ID NO: 4 | 7102 |
| PSEU192 | Monovalent nanobody | 2B10 | US20150044215 SEQ ID NO: 5 | 7103 |
| PSEU193 | Monovalent nanobody | 2G09 | US20150044215 SEQ ID NO: 6 | 7104 |
| PSEU194 | Monovalent nanobody | 6B05 | US20150044215 SEQ ID NO: 7 | 7105 |
| PSEU195 | Monovalent nanobody | 10C05 | US20150044215 SEQ ID NO: 8 | 7106 |
| PSEU196 | Monovalent nanobody | 11B09 | US20150044215 SEQ ID NO: 9 | 7107 |
| PSEU197 | Monovalent nanobody | 14E10 | US20150044215 SEQ ID NO: 10 | 7108 |
| PSEU198 | Monovalent nanobody | 7E09 | US20150044215 SEQ ID NO: 11 | 7109 |

TABLE 32-continued

Antibodies against *Pseudomonas Aeruginosa*

| Antibody No. | Description | Antibody Name | Reference Information | SEQ ID NO |
|---|---|---|---|---|
| PSEU199 | Monovalent nanobody | 13F07 | US20150044215 SEQ ID NO: 12 | 7110 |
| PSEU200 | Monovalent nanobody | 3B11 | US20150044215 SEQ ID NO: 13 | 7111 |
| PSEU201 | Monovalent nanobody | 4C03 | US20150044215 SEQ ID NO: 14 | 7112 |
| PSEU202 | Monovalent nanobody | 4G10 | US20150044215 SEQ ID NO: 15 | 7113 |
| PSEU203 | Monovalent nanobody | 12B02 | US20150044215 SEQ ID NO: 16 | 7114 |
| PSEU204 | Monovalent nanobody | 14B10 | US20150044215 SEQ ID NO: 17 | 7115 |
| PSEU205 | Monovalent nanobody | 3E10 | US20150044215 SEQ ID NO: 18 | 7116 |
| PSEU206 | Monovalent nanobody | 5E02 | US20150044215 SEQ ID NO: 19 | 7117 |
| PSEU207 | Scfv-Fc | W4-M1 | WO2014074528 SEQ ID NO: 78 | 7118 |
| PSEU208 | Scfv-Fc | W4-M5 | WO2014074528 SEQ ID NO: 79 | 7119 |
| PSEU209 | Scfv-Fc | W4-M6 | WO2014074528 SEQ ID NO: 80 | 7120 |
| PSEU210 | Scfv-Fc | W4-M7 | WO2014074528 SEQ ID NO: 81 | 7121 |
| PSEU211 | Scfv-Fc | W4-M8 | WO2014074528 SEQ ID NO: 82 | 7122 |
| PSEU212 | Scfv-Fc | W4-M9 | WO2014074528 SEQ ID NO: 83 | 7123 |
| PSEU213 | Scfv-Fc | W4-M11 | WO2014074528 SEQ ID NO: 84 | 7124 |
| PSEU214 | Scfv-Fc | W4-M12 | WO2014074528 SEQ ID NO: 85 | 7125 |
| PSEU215 | Scfv-Fc | W4-M14 | WO2014074528 SEQ ID NO: 86 | 7126 |
| PSEU216 | Scfv-Fc | W4-M15 | WO2014074528 SEQ ID NO: 87 | 7127 |
| PSEU217 | Scfv-Fc | W4-M16 | WO2014074528 SEQ ID NO: 88 | 7128 |
| PSEU218 | Scfv-Fc | W4-M17 | WO2014074528 SEQ ID NO: 89 | 7129 |
| PSEU219 | Scfv-Fc | W4-M19 | WO2014074528 SEQ ID NO: 90 | 7130 |
| PSEU220 | Scfv-Fc | W4-M20 | WO2014074528 SEQ ID NO: 91 | 7131 |
| PSEU221 | Sefv-Fc | W4-M4 | WO2014074528 SEQ ID NO: 92 | 7132 |
| PSEU222 | Scfv-Fc | W4-M10 | WO2014074528 SEQ ID NO: 93 | 7133 |
| PSEU223 | Scfv-Fc | W4-HC1-LCP | WO2014074528 SEQ ID NO: 94 | 7134 |
| PSEU224 | Scfv-Fc | W4-HC1-LC7 | WO2014074528 SEQ ID NO: 95 | 7135 |
| PSEU225 | Scfv-Fc | W4-HC2-LC7 | WO2014074528 SEQ ID NO: 96 | 7136 |
| PSEU226 | Scfv-Fc | W4-HC3-LCP | WO2014074528 SEQ ID NO: 97 | 7137 |
| PSEU227 | Scfv-Fc | W4-HC4-LCP | WO2014074528 SEQ ID NO: 98 | 7138 |
| PSEU228 | Scfv-Fc | W4-HC5-LCP | WO2014074528 SEQ ID NO: 99 | 7139 |
| PSEU229 | Scfv-Fc | W4-HC5-LC7 | WO2014074528 SEQ ID NO: 100 | 7140 |
| PSEU230 | Scfv-Fc | W4-HC7-LCP | WO2014074528 SEQ ID NO: 101 | 7141 |
| PSEU231 | Scfv-Fc | W4-VH1-VL8 | WO2014074528 SEQ ID NO: 102 | 7142 |
| PSEU232 | Scfv-Fc | W4-VH2-VLP | WO2014074528 SEQ ID NO: 103 | 7143 |
| PSEU233 | Scfv-Fc | W4-VH2-VL8 | WO2014074528 SEQ ID NO: 104 | 7144 |
| PSEU234 | Scfv-Fc | W4-VH3-VL7 | WO2014074528 SEQ ID NO: 105 | 7145 |
| PSEU235 | Scfv-Fc | W4-VH3-VL8 | WO2014074528 SEQ ID NO: 106 | 7146 |
| PSEU236 | Scfv-Fc | W4-VH5-VL8 | WO2014074528 SEQ ID NO: 107 | 7147 |
| PSEU237 | Scfv-Fc | W4-VH6-VL7 | WO2014074528 SEQ ID NO: 108 | 7148 |
| PSEU238 | Scfv-Fc | W4-VH6-VL8 | WO2014074528 SEQ ID NO: 109 | 7149 |
| PSEU239 | Scfv-Fc | W4-VH6-VLP | WO2014074528 SEQ ID NO: 110 | 7150 |
| PSEU240 | Scfv-Fc | W4-VH7-VLP | WO2014074528 SEQ ID NO: 111 | 7151 |
| PSEU241 | Scfv-Fc | W4-VH7-VL7 | WO2014074528 SEQ ID NO: 112 | 7152 |
| PSEU242 | Scfv-Fc | W4-VH7-VL8 | WO2014074528 SEQ ID NO: 113 | 7153 |
| PSEU243 | Scfv-Fc | W4-VH9-VLP | WO2014074528 SEQ ID NO: 114 | 7154 |
| PSEU244 | Scfv-Fc | W4-VH10-VLP | WO2014074528 SEQ ID NO: 115 | 7155 |
| PSEU245 | Scfv-Fc | W4-VH11-VLP | WO2014074528 SEQ ID NO: 116 | 7156 |
| PSEU246 | Scfv-Fc | W4-VH12-VLP | WO2014074528 SEQ ID NO: 117 | 7157 |
| PSEU247 | Scfv-Fc | W4-VH15-VLP | WO2014074528 SEQ ID NO: 118 | 7158 |
| PSEU248 | Scfv-Fc | W4-VH16-VLP | WO2014074528 SEQ ID NO: 119 | 7159 |
| PSEU249 | Scfv-Fc | W4-VH20-VLP | WO2014074528 SEQ ID NO: 120 | 7160 |
| PSEU250 | Scfv-Fc | W4-VH31-VLP | WO2014074528 SEQ ID NO: 121 | 7161 |
| PSEU251 | Scfv-Fc | W4-VH37-VLP | WO2014074528 SEQ ID NO: 122 | 7162 |
| PSEU252 | Scfv-Fc | W4-VH41-VLP | WO2014074528 SEQ ID NO: 123 | 7163 |
| PSEU253 | Scfv-Fc | W4-VH42-VLP | WO2014074528 SEQ ID NO: 124 | 7164 |
| PSEU254 | Scfv-Fc | W4-VH35-VLP | WO2014074528 SEQ ID NO: 125 | 7165 |
| PSEU255 | Scfv-Fc | W4-VH36-VLP | WO2014074528 SEQ ID NO: 126 | 7166 |
| PSEU256 | Scfv-Fc | W4-VH52-VLP | WO2014074528 SEQ ID NO: 127 | 7167 |
| PSEU257 | Scfv-Fc | W4-VH53-VLP | WO2014074528 SEQ ID NO: 128 | 7168 |
| PSEU258 | Scfv-Fc | W4-VH54-VLP | WO2014074528 SEQ ID NO: 129 | 7169 |
| PSEU259 | Scfv-Fc | W4-VH55-VLP | WO2014074528 SEQ ID NO: 130 | 7170 |
| PSEU260 | Scfv-Fc | W4-VH56-VLP | WO2014074528 SEQ ID NO: 131 | 7171 |
| PSEU261 | Scfv-Fc | W4-VH57-VLP | WO2014074528 SEQ ID NO: 132 | 7172 |
| PSEU262 | Scfv-Fc | W4-VH58-VLP | WO2014074528 SEQ ID NO: 133 | 7173 |
| PSEU263 | Scfv-Fc | W4-VH60-VLP | WO2014074528 SEQ ID NO: 134 | 7174 |
| PSEU264 | Scfv-Fc | W4-VH61-VLP | WO2014074528 SEQ ID NO: 135 | 7175 |
| PSEU265 | Scfv-Fc | W4-VH62-VLP | WO2014074528 SEQ ID NO: 136 | 7176 |
| PSEU266 | Scfv-Fc | W4-VH63-VLP | WO2014074528 SEQ ID NO: 137 | 7177 |
| PSEU267 | Scfv-Fc | W4-VH64-VLP | WO2014074528 SEQ ID NO: 138 | 7178 |
| PSEU268 | Scfv-Fc | W4-VH65-VLP | WO2014074528 SEQ ID NO: 139 | 7179 |
| PSEU269 | Scfv-Fc | W4-VH66-VLP | WO2014074528 SEQ ID NO: 140 | 7180 |
| PSEU270 | Scfv-Fc | W4-VH67-VLP | WO2014074528 SEQ ID NO: 141 | 7181 |
| PSEU271 | Scfv-Fc | W4-VH69-VLP | WO2014074528 SEQ ID NO: 142 | 7182 |
| PSEU272 | Scfv-Fc | W4-VH70-VLP | WO2014074528 SEQ ID NO: 143 | 7183 |

TABLE 32-continued

Antibodies against Pseudomonas Aeruginosa

| Antibody No. | Description | Antibody Name | Reference Information | SEQ ID NO |
|---|---|---|---|---|
| PSEU273 | Scfv-Fc | W4-VH72-VLP | WO2014074528 SEQ ID NO: 144 | 7184 |
| PSEU274 | Scfv-Fc | W4-VH79-VLP | WO2014074528 SEQ ID NO: 145 | 7185 |
| PSEU275 | Scfv-Fc | W4-VH80-VLP | WO2014074528 SEQ ID NO: 146 | 7186 |
| PSEU276 | Scfv-Fc | W4-M9 | WO2014074528 SEQ ID NO: 152 | 7187 |
| PSEU277 | Scfv-Fc | Psl0170 | WO2014074528 SEQ ID NO: 245 | 7188 |
| PSEU278 | Scfv-Fc | Psl0304 | WO2014074528 SEQ ID NO: 246 | 7189 |
| PSEU279 | Scfv-Fc | Psl0348 | WO2014074528 SEQ ID NO: 247 | 7190 |
| PSEU280 | Scfv-Fc | Psl0573 | WO2014074528 SEQ ID NO: 248 | 7191 |
| PSEU281 | Scfv-Fc | Psl0574 | WO2014074528 SEQ ID NO: 249 | 7192 |
| PSEU282 | Scfv-Fc | Psl0582 | WO2014074528 SEQ ID NO: 250 | 7193 |
| PSEU283 | Scfv-Fc | Psl0584 | WO2014074528 SEQ ID NO: 251 | 7194 |
| PSEU284 | Scfv-Fc | Psl0585 | WO2014074528 SEQ ID NO: 252 | 7195 |
| PSEU285 | Scfv-Fc | Psl0589 | WO2014074528 SEQ ID NO: 253 | 7196 |

In one embodiment, the payload region of the AAV particle comprises one or more nucleic acid sequences encoding one or more of the payload antibody polypeptides listed in Table 33 against Streptococcus bacteria.

TABLE 33

Antibodies against Streptococcus bacteria

| Antibody No. | Description | Antibody Name | Reference Information | SEQ ID NO |
|---|---|---|---|---|
| STRP1 | Heavy chair variable region, Diabody for Streptococcus | | US7625561 SEQ ID NO: 5 | 7197 |
| STRP2 | Heavy chain variable region, Diabody for Streptococcus | | US7625561 SEQ ID NO: 3 | 7198 |
| STRP3 | Heavy chain variable region, Diabody for Streptococcus | | US7625561 SEQ ID NO: 7 | 7199 |
| STRP4 | Heavy chain variable region, partial, Streptococcus pneumoniae | DP-54 | Lucas, A.H. "Combinatorial library cloning of human antibodies to Streptococcus pneumoniae capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48823 | 7200 |
| STRP5 | Heavy chain variable region, partial, Streptococcus pneumoniae | DP-35 | Lucas, A.H. "Combinatorial library cloning of human antibodies to Streptococcus pueumoniae capsular polysaccharides: variable region primary structures and evidence for somatic mutation of Fab fragments specific for capsular serotypes 6B, 14, and 23F," Infect. Immun. 69 (2), 853-864 (2001), NCBI Accession # AAD48825 | 7201 |
| STRP6 | Heavy chain variable region, partial, Streptococcus pneumoniae | DP-47 | Lucas, A.H. "Combinatorial library cloning of human antibodies to Streptococcus pneumoniae capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48827 | 7202 |
| S'I7RP7 | Heavy chain variable region, partial, Streptococcus pneumoniae | DP-47 | Lucas, A.H. "Combinatorial library cloning of human antibodies to Streptococcus pneumoniae capsular polysaccharides: variable region primary structures and evidence for somatic mutation of Fab fragments specific for capsular serotypes 6B, 14, and 23F" Infect. Immun. 69 (2), 853-864 (2001,) NCBI Accession # AAD48828 | 7203 |
| S'IRP8 | Heavy chain variable region, partial, Streptococcus pneumoniae | LSG-6 1 | Lucas, A.H. "Combinatorial library cloning of hurnan antibodies to Streptococcus pneumoniae capsular polysaccharides: variable region primary structures and evidence for somatic mutation of Fab fragments specific for capsular | 7204 |

TABLE 33-continued

Antibodies against *Streptococcus* bacteria

| Antibody No. | Description | Antibody Name | Reference Information | SEQ ID NO |
|---|---|---|---|---|
| STRP9 | Heavy chain variable region, partial, *Streptococcus pneumoniae* | LSG6.1 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48830 | 7205 |
| STRP10 | Heavy chain variable region, partial, *Streptococcus pneumoniae* | DP-47 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48832 | 7206 |
| | | | NCBI Accession # AAD48835 | |
| STRP11 | Heavy chain variable region, *Streptococcus agalactiae, Legionella pneumophilia, Streptococcus pyogenes, Escherichia coli, Neisseria gonorrhoeae, Neisseria meningitidis, Pneumococcus, Hemophilis influenzae B, Treponema pallidum,* Lyme disease spirochetes, *Pseudomonas aeruginosa, Mycobacterium leprae, Brucella abortus* and *Mycobacterium tuberculosis.* | humanized Mu-9 | US7429381 SEQ ID NO: 14 | 6902 |
| STRP12 | Heavy chain variable region. *Streptococcus pneumoniae* | Anti-PsaA 7-1G9 | US20070003561 SEQ ID NO: 16 | 7207 |
| STRP13 | Heavy chain variable region, *Streptococcus pneumoniae* | Anti-PsaA 1-15E5 | US20070003561 SEQ ID NO: 32 | 7208 |
| STRP14 | Heavy chain variable region, *Streptococcus pneumoniae* | Anti-PsaA 9A7 | US20070003561 SEQ ID NO: 48 | 7209 |
| STRP15 | Heavy chain variable region, *Streptococcus pneumoniae* | 23f Fab 023.102, chain B | Bryson, S., "Multitasking immimoglobulin V-Genes And Somatic Div Cdr3 Loops Generate Binding Sites For Chemically Di Antigens From Bacterial And. Viral Pathogens" Unpublished", NCBI Accession # 4HIE B | 7210 |
| STRP16 | Heavy chain variable region, *Streptococcus pneumoniae, Escherichia coli,* or *Pseudomonas aeruginosa* | 5.12.14 | US5686070 SEQ ID NO: 22 | 7211 |
| SIRP17 | Heavy chain variable region, *Streptococcus pneumoniae, Escherichia coli,* or *Pseudomonas aeruginosa* | 6G4.2.5 | US5686070 SEQ ID NO: 50 | 7212 |
| STRP18 | Heavy chain variable region, *Streptococcus pneumoniae Escherichia coli,* or *Pseudomonas aeruginosa* | chimeric 6G4.2.5 | US5686070 SEQ ID NO: 58 | 7213 |
| STRP19 | Heavy chain, *Streptococcus agalactiae, Legionella pneumophilia, Streptococcus pyogenes, Escherichia coli, Neisseria gonorrhoeae, Neisseria meningitidis, Pneumococcus, Hemophilis influenzae B, Treponema palliduni Lyrae* disease spirochetes, *Pseudomonas aeruginosa, Mycobacterium leprae, Brucella abortus* and *Mycobacterium tuberculosis.* | Mab6679 | US7429381 SEQ ID NO: 4 | 6900 |

TABLE 33-continued

Antibodies against *Streptococcus* bacteria

| Antibody No. | Description | Antibody Name | Reference Information | SEQ ID NO |
|---|---|---|---|---|
| STRP20 | Light chain variable region, Diabody for *Streptococcus* | | US7625561 SEQ ID NO: 6 | 7214 |
| STRP21 | Light chain variable region, Diabody for *Streptococcus* | | US7625561 SEQ ID NO: 8 | 7215 |
| STRP22 | Light chain variable region, Diabody for *Streptococcus* | | US7625561 SEQ ID NO: 4 | 7216 |
| STRP23 | Light chain variable region, partial, *Streptococcus pneumoniae* | A2 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48824 | 7217 |
| STRP24 | Light chain variable region, partial, *Streptococcus pneumoniae* | 133 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48822 | 7218 |
| STRP25 | Light chain variable region, partial, *Streptococcus pneumoniae* | A23 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48826 | 7219 |
| STRP26 | Light chain variable region, partial, *Streptococcus pneumoniae* | L2 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48829 | 7220 |
| STRP27 | Light chain variable region, partial, *Streptococcus pneumoniae* | DPL5 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48831 | 7221 |
| STRP28 | Light chain variable region, partial, *Streptococcus pneumoniae* | DPL5 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. Immun. 69 (2), 853-864 (2001), NCBI Accession # AAD48833 | 7222 |
| STRP29 | Light chain variable region, partial, *Streptococcus pneumoniae* | L2 | Lucas, A.H. "Combinatorial library cloning of human antibodies to *Streptococcus pneumoniae* capsular polysaccharides: variable region primary structures and evidence for somatic mutation of Fab fragments specific for capsular serotypes 6B, 14, and 23F" Infect. | 7223 |

TABLE 33-continued

Antibodies against *Streptococcus* bacteria

| Antibody No. | Description | Antibody Name | Reference Information | SEQ ID NO |
|---|---|---|---|---|
| | | | Immun. 69 (2), 853-864 (2001), NCBI Accession # AAD48834 | |
| STRP30 | Light chain variable region, *Streptococcus pneumoniae* | Anti-PsaA 7-1G9 | US20070003561 SEQ ID NO: 8 | 7224 |
| STRP31 | Light chain variable region, *Streptococcus pneumoniae* | Anti-PsaA 1-15E5 | US20070003561 SEQ ID NO: 24 | 7225 |
| STRP32 | Light chain variable region, *Streptococcus pneumoniae* | Anti-pSaA 9A7 | US20070003561 SEQ ID NO: 40 | 7226 |
| STRP33 | Light chain variable region, *Streptococcus pneumoniae*, *Escherichia coli*, or *Pseudomonas aeruginosa* | 5.12.14 | US5686070 SEQ ID NO: 20 | 7227 |
| STRP34 | Light chain variable region, *Streptococcus pneumoniae*, *Escherichia coli*, or *Pseudomonas aeruginosa* | 6G4.2.5 | US5686070 SEQ ID NO: 48 | 7228 |
| STRP35 | Light chain variable region, *Streptococcus pneumoniae*, *Escherichia coli*, or *Pseudomonas aeruginosa* | chimeric 6G4.2.5 | US5686070 SEQ ID NO: 56 | 7229 |
| STRP36 | Light chain, *Streptococcus agalactiae*, *Legionella pneumophila*, *Streptococcus pyogenes*, *Escherichia coli*, *Neisseria gonorrhoeae*, *Neisseria meningitidis*, Pneumococcus, *Hemophilis influenzae B*, *Treponema pallidum*, Lyme disease spirochetes, *Pseudomonas aeruginosa*, *Mycobacterium leprae*, *Brucella abortus* and *Mycobacterium tuberculosis* | Mab679 | US7429381 SEQ ID NO: 2 | 6907 |
| STRP37 | scFv, *Streptococcus agalactiae*, *Legionella pneumophila*, *Streptococcus pyogenes*, *Escherichia coli*, *Neisseria gonorrhoeae*, *Neisseria meningitidis*, Pneumococcus, *Hemophilis influenzae B*, *Treponema pallidum*, Lyme disease spirochetes, *Pseudomonas aeruginosa*, *Mycobacterium leprae*, *Brucella abortus* and *Mycobacterium tuberculosis* | Mab679 | US7429381 SEQ ID NO: 6 | 6911 |
| STRP38 | scFv, *Streptococcus agalactiae*, *Legionella pneumophila*, *Streptococcus pyogenes*, *Escherichia coli*, *Neisseria gonorrhoeae*, *Neisseria meningitidis*, Pneumococcus, *Hemophilis influenzae B*, *Treponema pallidum*, Lyme disease spirochetes, *Pseudomonas aeruginosa*, *Mycobacterium leprae*, *Brucella abortus* and *Mycobacterium tuberculosis* | Mu-9V | US7429381 SEQ ID NO: 8 | 6905 |
| STRP39 | scFv, *Streptococcus agalactiae*, *Legionella pneumophila*, *Streptococcus pyogenes*, *Escherichia coli*, *Neisseria gonorrhoeae*, *Neisseria meningitidis*, Pneumococcus, *Hemophilis influenzae B*, *Treponema pallidum*, Lyme disease spirochetes, *Pseudomonas aeruginosa*, *Mycobacterium leprae*, *Brucella abortus* and *Mycobacterium tuberculosis* | Mu-9V | US7429381 SEQ ID NO: 10 | 6901 |
| STRP40 | scFv, *Streptococcus agalactiae*, *Legionella pneumophila*, *Streptococcus pyogenes*, *Escherichia coli*, *Neisseria gonorrhoeae*, *Neisseria | humanized Mu-9 | US7429381 SEQ ID NO: 12 | 6906 |

TABLE 33-continued

Antibodies against *Streptococcus* bacteria

| Antibody No. | Description | Antibody Name | Reference Information | SEQ ID NO |
|---|---|---|---|---|
| | *meningitidis, Pneumococcus, Hemophilis influenzae B, Treponema pallidum*, Lyme disease spirochetes, *Pseudomonas aeruginosa, Mycobacterium leprae, Brucella abortus* and *Mycobacterium tuberculosis* | | | |

In one embodiment, the payload region of the AAV particle comprises one or more nucleic acid sequences, fragment or variants thereof or encodes one or more polypeptides, fragments or variants thereof described in US Pub No. US20040198960 and US20130195876, the contents of each of which are herein incorporated by reference in their entirety, against *Streptococcus pneumoniae* infection.

In one embodiment, the payload region of the AAV particle comprises one or more nucleic acid sequences, fragment or variants encoding Afelimomab, fragments or variants thereof for treating a disease and/or disorder or preventing a disease and/or disorder. As a non-limiting example, the disease and/or disorder is sepsis.

In one embodiment, the payload region of the AAV particle comprises one or more nucleic acid sequences, fragment or variants encoding Nebacumab, fragments or variants thereof for treating a disease and/or disorder or preventing a disease and/or disorder. As a non-limiting example, the disease and/or disorder is sepsis.

In one embodiment, the payload region of the AAV particle comprises one or more nucleic acid sequences encoding one or more of the payload antibody polypeptides listed in Table 34 against Staphylococcal bacteria and related bacteria.

TABLE 34

Antibodies against Staphylococcal bacteria and related bacteria

| Antibody No. | Description | Antibody Name | Reference Information | SEQ ID NO |
|---|---|---|---|---|
| STPH1 | Heavy chain variable region, *S. aureus* | | U.S. Pat. No. 8,609,102 SEQ ID NO: 2 | 7230 |
| STPH2 | Heavy chain variable region, *S. aureus* | | U.S. Pat. No. 8,609,102 SEQ ID NO: 6 | 7231 |
| STPH3 | Heavy chain variable region, *S. aureus* or *S. epidermidis, E. coli, Yersinia pestis* (*Y. pestis*), *Y. entercolitica, Xanthomnonas axonopodis* (*X. axonopodis*), *Pseudonmonas fuorescerns* (*P. fluorescens*), *Actinobacillus actinomycetemcomitans* (*A. actinomycetemcomitans*), *A. pleuropneumoniae, Ralstonia solanacearum* (*R. solanacearum*), *Bordetella pertussis* (*B. pertussis*), *B. parapertussis* or *B. bronchiseptica* | SAR279356 | U.S. Pat. No. 7,786,255 SEQ ID NO: 1 | 7232 |
| STPH4 | Heavy chain variable region, *S. aureus* or *S. epidermidis, E. coli, Yersinia pestis* (*Y. pestis*), *Y. entercolitica, Xanthomnonas axonopodis* (*X. axonopodis*), *Pseudonmonas fuorescerns* (*P. fluorescens*), *Actinobacillus actinomycetemcomitans* (*A. actinomycetemcomitans*), *A. pleuropneumoniae, Ralstonia solanacearum* (*R. solanacearum*), *Bordetella pertussis* (*B. pertussis*), *B. parapertussis* or *B. bronchiseptica* | SAR279356 | US20110002932 SEQ ID NO: 1 | 7233 |
| STPH5 | Heavy chain variable region, *S. epidermidis* | 108-1 | U.S. Pat. No. 8,475,798 SEQ ID NO: 18 | 7234 |
| STPH6 | Heavy chain variable region, *S. epidermidis* | 108-36 | U.S. Pat. No. 8,475,798 SEQ ID NO: 22 | 7235 |
| STPH7 | Heavy chain variable region, *S. epidermidis* | 110-15 | U.S. Pat. No. 8,475,798 SEQ ID NO: 26 | 7236 |
| STPH8 | Heavy chain variable region, *S. epidermidis* | 108-1VH-Hu | U.S. Pat. No. 8,475,798 SEQ ID NO: 28 | 7237 |
| STPH9 | Heavy chain variable region, *S. epidermidis* | 108-36VH-Hu | U.S. Pat. No. 8,475,798 SEQ ID NO: 30 | 7238 |
| STPH10 | Heavy chain variable region, *S. epidermidis* | 110-15VH-Hu | U.S. Pat. No. 8,475,798 SEQ ID NO: 32 | 7239 |

TABLE 34-continued

Antibodies against Staphylococcal bacteria and related bacteria

| Antibody No. | Description | Antibody Name | Reference Information | SEQ ID NO |
|---|---|---|---|---|
| STPH11 | Heavy chain variable region, Staphylococcal sepsis | Pagibaximab | U.S. Pat. No. 8,372,958 SEQ ID NO: 87 | 7240 |
| STPH12 | Heavy chain variable region, Staphylococcal sepsis | Pagibaximab | U.S. Pat. No. 8,372,958 SEQ ID NO: 12 | 7241 |
| STPH13 | Heavy chain variable region, Staphylococcal sepsis | Pagibaximab | U.S. Pat. No. 8,372,958 SEQ ID NO: 17 | 7242 |
| STPH14 | Heavy chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F628 | U.S. Pat. No. 8,912,314 SEQ ID NO: 3 | 7243 |
| STPH15 | Heavy chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F630 | U.S. Pat. No. 8,912,314 SEQ ID NO: 5 | 7244 |
| STPH16 | Heavy chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F598 | U.S. Pat. No. 8,912,314 SEQ ID NO: 55 | 7245 |
| STPH17 | Heavy chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F628 | U.S. Pat. No. 8,912,314 SEQ ID NO: 58 | 7246 |
| STPH18 | Heavy chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete | F598 | U.S. Pat. No. 8,912,314 SEQ ID NO: 1 | 7247 |

TABLE 34-continued

Antibodies against Staphylococcal bacteria and related bacteria

| Antibody No. | Description | Antibody Name | Reference Information | SEQ ID NO |
|---|---|---|---|---|
| | pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | | | |
| STPH19 | Heavy chain variable region, *Staphylococcus epidermidis* | 108-3BVH-Hu | U.S. Pat. No. 8,475,798 SEQ ID NO: 34 | 7248 |
| STPH20 | Heavy chain, MRSA, MSSA | 2B2 | U.S. Pat. No. 8,735,554 SEQ ID NO: 3 | 7249 |
| STPH21 | Heavy chain, MRSA, MSSA | 2G7 | U.S. Pat. No. 8,735,554 SEQ ID NO: 5 | 7250 |
| STPH22 | Heavy chain, MRSA, MSSA | 3B12 | U.S. Pat. No. 8,735,554 SEQ ID NO: 7 | 7251 |
| STPH23 | Heavy chain, *S. aureus* | DF1.1 | U.S. Pat. No. 8,715,673 SEQ ID NO: 2 | 7252 |
| STPH24 | Heavy chain, *S. aureus* | DF1 | U.S. Pat. No. 8,715,673 SEQ ID NO: 4 | 7253 |
| STPH25 | Heavy chain, *S. aureus* | DF2 | U.S. Pat. No. 8,715,673 SEQ ID NO: 35 | 7254 |
| STPH26 | Heavy chain, *S. aureus* | DF3 | U.S. Pat. No. 8,715,673 SEQ ID NO: 36 | 7255 |
| STPH27 | Heavy chain, *S. aureus* | DF4 | U.S. Pat. No. 8,715,673 SEQ ID NO: 37 | 7256 |
| STPH28 | Heavy chain, *S. aureus* | DF5 | U.S. Pat. No. 8,715,673 SEQ ID NO: 38 | 7257 |
| STPH29 | Heavy chain, *S. aureus* | DF6 | U.S. Pat. No. 8,715,673 SEQ ID NO: 39 | 7258 |
| STPH30 | Heavy chain, *S. aureus* | DF7 | U.S. Pat. No. 8,715,673 SEQ ID NO: 40 | 7259 |
| STPH31 | Heavy chain, *S. aureus* | DF8 | U.S. Pat. No. 8,715,673 SEQ ID NO: 41 | 7260 |
| STPH32 | Heavy chain, *S. aureus* | DF9 | U.S. Pat. No. 8,715,673 SEQ ID NO: 42 | 7261 |
| STPH33 | Heavy chain, *S. aureus* | DF10 | U.S. Pat. No. 8,715,673 SEQ ID NO: 43 | 7262 |
| STPH34 | Heavy chain, *S. aureus* | DF11 | U.S. Pat. No. 8,715,673 SEQ ID NO: 44 | 7263 |
| STPH35 | Heavy chain, *S. aureus* | DF12 | U.S. Pat. No. 8,715,673 SEQ ID NO: 45 | 7264 |
| STPH36 | Heavy chain, *S. aureus* | DF13 | U.S. Pat. No. 8,715,673 SEQ ID NO: 46 | 7265 |
| STPH37 | Heavy chain, *S. aureus* | DF14 | U.S. Pat. No. 8,715,673 SEQ ID NO: 47 | 7266 |
| STPH38 | Heavy chain, *S. aureus* | DF15 | U.S. Pat. No. 8,715,673 SEQ ID NO: 48 | 7267 |
| STPH39 | Heavy chain, *S. aureus* | DF16 | U.S. Pat. No. 8,715,673 SEQ ID NO: 49 | 7268 |
| STPH40 | Heavy chain, *S. aureus* | DF17 | U.S. Pat. No. 8,715,673 SEQ ID NO: 50 | 7269 |
| STPH41 | Heavy chain, *S. aureus* | DF18 | U.S. Pat. No. 8,715,673 SEQ ID NO: 51 | 7270 |
| STPH42 | Heavy chain, *S. aureus* | DF19 | U.S. Pat. No. 8,715,673 SEQ ID NO: 52 | 7271 |
| STPH43 | Heavy chain, *S. aureus* | DF20 | U.S. Pat. No. 8,715,673 SEQ ID NO: 53 | 7272 |
| STPH44 | Heavy chain, *S. aureus* and *S. epidermidis* | CR2430 | U.S. Pat. No. 8,460,666 SEQ ID NO: 26 | 7273 |
| STPH45 | Heavy chain, *S. aureus* and *S. epidermidis* | CR5132 | U.S. Pat. No. 8,460,666 SEQ ID NO: 28 | 7274 |
| STPH46 | Heavy chain, *S. aureus* and *S. epidermidis* | CR5133 | U.S. Pat. No. 8,460,666 SEQ ID NO: 30 | 7275 |
| STPH47 | Heavy chain, *S. aureus* and *S. epidermidis* | CR6166 | U.S. Pat. No. 8,460,666 SEQ ID NO: 117 | 7276 |
| STPH48 | Heavy chain, *S. aureus* and *S. epidermidis* | CR6171 | U.S. Pat. No. 8,460,666 SEQ ID NO: 119 | 7277 |
| STPH49 | Heavy chain, *S. aureus* and *S. epidermidis* | CR6176 | U.S. Pat. No. 8,460,666 SEQ ID NO: 121 | 7278 |
| STPH50 | Heavy chain, *S. aureus* and *S. epidermidis* | CR6187 | U.S. Pat. No. 8,460,666 SEQ ID NO: 123 | 7279 |
| STPH51 | Heavy chain, *S. aureus* and *S. epidermidis* | CR6193 | U.S. Pat. No. 8,460,666 SEQ ID NO: 125 | 7280 |

TABLE 34-continued

Antibodies against Staphylococcal bacteria and related bacteria

| Antibody No. | Description | Antibody Name | Reference Information | SEQ ID NO |
|---|---|---|---|---|
| STPH52 | Heavy chain, *S. aureus* and *S. epidermidis* | CR6249 | U.S. Pat. No. 8,460,666 SEQ ID NO: 127 | 7281 |
| STPH53 | Heavy chain, *S. aureus* and *S. epidermidis* | CR6273 | U.S. Pat. No. 8,460,666 SEQ ID NO: 129 | 7282 |
| STPH54 | Heavy chain, *S. aureus* and *S. epidermidis* | CR6389 | U.S. Pat. No. 8,460,666 SEQ ID NO: 131 | 7283 |
| STPH55 | Heavy chain, *S. aureus* and *S. epidermidis* | CR6403 | U.S. Pat. No. 8,460,666 SEQ ID NO: 133 | 7284 |
| STPH56 | Heavy chain, *S. aureus* and *S. epidermidis* | CR6406 | U.S. Pat. No. 8,460,666 SEQ ID NO: 135 | 7285 |
| STPH57 | Heavy chain, *S. aureus* and *S. epidermidis* | CR6410 | U.S. Pat. No. 8,460,666 SEQ ID NO: 137 | 7286 |
| STPH58 | Heavy chain, *S. aureus* and *S. epidermidis* | CR6446 | U.S. Pat. No. 8,460,666 SEQ ID NO: 139 | 7287 |
| STPH59 | Heavy chain, *S. aureus* and *S. epidermidis* | CR6450 | U.S. Pat. No. 8,460,666 SEQ ID NO: 141 | 7288 |
| STPH60 | Heavy chain, *S. aureus* and *S. epidermidis* | CR6452 | U.S. Pat. No. 8,460,666 SEQ ID NO: 143 | 7289 |
| STPH61 | Heavy chain, *S. aureus* and *S. epidermidis* | CR6453 | U.S. Pat. No. 8,460,666 SEQ ID NO: 145 | 7290 |
| STPH62 | Heavy chain, *S. aureus* and *S. epidermidis* | CR6464 | U.S. Pat. No. 8,460,666 SEQ ID NO: 147 | 7291 |
| STPH63 | Heavy chain, *S. aureus* and *S. epidermidis* | CR6471 | U.S. Pat. No. 8,460,666 SEQ ID NO: 149 | 7292 |
| STPH64 | Heavy chain, *S. aureus* and *S. epidermidis* | CR6516 | U.S. Pat. No. 8,460,666 SEQ ID NO: 151 | 7293 |
| STPH65 | Heavy chain, *S. aureus* and *S. epidermidis* | CR6517 | U.S. Pat. No. 8,460,666 SEQ ID NO: 153 | 7294 |
| STPH66 | Heavy chain, *S. aureus* and *S. epidermidis* | CR6526 | U.S. Pat. No. 8,460,666 SEQ ID NO: 155 | 7295 |
| STPH67 | Heavy chain, *S. aureus* and *S. epidermidis* | CR6528 | U.S. Pat. No. 8,460,666 SEQ ID NO: 157 | 7296 |
| STPH68 | Heavy chain, *S. aureus* and *S. epidermidis* | CR6531 | U.S. Pat. No. 8,460,666 SEQ ID NO: 159 | 7297 |
| STPH69 | Heavy chain, *S. aureus* and *S. epidermidis* | CR6533 | U.S. Pat. No. 8,460,666 SEQ ID NO: 161 | 7298 |
| STPH70 | Heavy chain, *S. aureus* and *S. epidermidis* | CR6536 | U.S. Pat. No. 8,460,666 SEQ ID NO: 163 | 7299 |
| STPH71 | Heavy chain, *S. aureus* and *S. epidermidis* | CR6537 | U.S. Pat. No. 8,460,666 SEQ ID NO: 165 | 7300 |
| STPH72 | Heavy chain, *S. aureus* and *S. epidermidis* | CR6538 | U.S. Pat. No. 8,460,666 SEQ ID NO: 167 | 7301 |
| STPH73 | Heavy chain, *S. aureus* and *S. epidermidis* | CR6540 | U.S. Pat. No. 8,460,666 SEQ ID NO: 169 | 7302 |
| STPH74 | Heavy chain, *S. aureus* and *S. epidermidis* | CR6544 | U.S. Pat. No. 8,460,666 SEQ ID NO: 171 | 7303 |
| STPH75 | Heavy chain, *S. aureus* and *S. epidermidis* | CR6566 | U.S. Pat. No. 8,460,666 SEQ ID NO: 173 | 7304 |
| STPH76 | Heavy chain, *S. aureus* and *S. epidermidis* | CR6625 | U.S. Pat. No. 8,460,666 SEQ ID NO: 175 | 7305 |
| STPH77 | Heavy chain, *S. aureus, Enterococcus* | CR5140 | U.S. Pat. No. 8,628,776 SEQ ID NO: 395 | 7306 |
| STPH78 | Heavy chain, *S. aureus, Enterococcus* | CR5159 | U.S. Pat. No. 8,628,776 SEQ ID NO: 82 | 7307 |
| STPH79 | Heavy chain, *S. aureus, Enterococcus* | CR5179 | U.S. Pat. No. 8,628,776 SEQ ID NO: 399 | 7308 |
| STPH80 | Heavy chain, *S. aureus, Enterococcus* | CR6016 | U.S. Pat. No. 8,628,776 SEQ ID NO: 88 | 7309 |
| STPH81 | Heavy chain, *S. aureus, Enterococcus* | CR6049 | U.S. Pat. No. 8,628,776 SEQ ID NO: 92 | 7310 |
| STPH82 | Heavy chain, *S. aureus. Enterococcus* | CR6071 | U.S. Pat. No. 8,628,776 SEQ ID NO: 94 | 7311 |
| STPH83 | Heavy chain, *S. aureus, Enterococcus* | CR6078 | U.S. Pat. No. 8,628,776 SEQ ID NO: 96 | 7312 |
| STPH84 | Heavy chain, *S. aureus, Enterococcus* | CR6086 | U.S. Pat. No. 8,628,776 SEQ ID NO: 407 | 7313 |
| STPH85 | Heavy chain, *S. aureus, Enterococcus* | CR6089 | U.S. Pat. No. 8,628,776 SEQ ID NO: 213 | 7314 |
| STPH86 | Heavy chain, *S. aureus, Enterococcus* | CR6191 | UU.S. Pat. No. 8,628,776 SEQ ID NO: 411 | 7315 |
| STPH87 | Heavy chain, *S. aureus, Enterococcus* | CR6198 | U.S. Pat. No. 8,628,776 SEQ ID NO: 415 | 7316 |
| STPH88 | Heavy chain, *S. aureus, Enterococcus* | CR6242 | U.S. Pat. No. 8,628,776 SEQ ID NO: 417 | 7317 |

TABLE 34-continued

Antibodies against Staphylococcal bacteria and related bacteria

| Antibody No. | Description | Antibody Name | Reference Information | SEQ ID NO |
|---|---|---|---|---|
| STPH89 | Heavy chain, S. aureus, Enterococcus | CR6252 | U.S. Pat. No. 8,628,776 SEQ ID NO: 100 | 7318 |
| STPH90 | Heavy chain, S. aureus, Enterococcus | CR6389 | 0U.S. Pat. No. 8,628,776 SEQ ID NO: 423 | 7319 |
| STPH91 | Heavy chain, S. aureus, Enterococcus | CR6402 | U.S. Pat. No. 8,628,776 SEQ ID NO: 427 | 7320 |
| STPH92 | Heavy chain, S. aureus, Enterococcus | CR6415 | U.S. Pat. No. 8,628,776 SEQ ID NO: 431 | 7321 |
| STPH93 | Heavy chain, S. aureus, Enterococcus | CR6429 | U.S. Pat. No. 8,628,776 SEQ ID NO: 435 | 7322 |
| STPH94 | Heavy chain, S. aureus, Enterococcus | CR5140 | U.S. Pat. No. 8,628,776 SEQ ID NO: 439 | 7323 |
| STPH95 | Heavy chain, S. aureus, Enterococcus | CR5159 | U.S. Pat. No. 8,628,776 SEQ ID NO: 102 | 7324 |
| STPH96 | Heavy chain, S. aureus, Enterococcus | CR5179 | U.S. Pat. No. 8,628,776 SEQ ID NO: 443 | 7325 |
| STPH97 | Heavy chain, S. aureus, Enterococcus | CR6016 | U.S. Pat. No. 8,628,776 SEQ ID NO: 108 | 7326 |
| STPH98 | Heavy chain, S. aureus, Enterococcus | CR6049 | U.S. Pat. No. 8,628,776 SEQ ID NO: 112 | 7327 |
| STPH99 | Heavy chain, S. aureus, Enterococcus | CR6071 | U.S. Pat. No. 8,628,776 SEQ ID NO: 114 | 7328 |
| STPH100 | Heavy chain, S. aureus, Enterococcus | CR6078 | U.S. Pat. No. 8,628,776 SEQ ID NO: 116 | 7329 |
| STPH101 | Heavy chain, S. aureus, Enterococcus | CR6086 | U.S. Pat. No. 8,628,776 SEQ ID NO: 451 | 7330 |
| STPH102 | Heavy chain, S. aureus, Enterococcus | CR6089 | U.S. Pat. No. 8,628,776 SEQ ID NO: 217 | 7331 |
| STPH103 | Heavy chain, S. aureus, Enterococcus | CR6191 | U.S. Pat. No. 8,628,776 SEQ ID NO: 455 | 7332 |
| STPH104 | Heavy chain, S. aureus, Enterococcus | CR6198 | U.S. Pat. No. 8,628,776 SEQ ID NO: 459 | 7333 |
| STPH105 | Heavy chain, S. aureus, Enterococcus | CR6242 | U.S. Pat. No. 8,628,776 SEQ ID NO: 461 | 7334 |
| STPH106 | Heavy chain, S. aureus, Enterococcus | CR6252 | U.S. Pat. No. 8,628,776 SEQ ID NO: 120 | 7335 |
| STPH107 | Heavy chain, S. aureus, Enterococcus | CR6389 | U.S. Pat. No. 8,628,776 SEQ ID NO: 467 | 7336 |
| STPH108 | Heavy chain, S. aureus, Enterococcus | CR6402 | U.S. Pat. No. 8,628,776 SEQ ID NO: 471 | 7337 |
| STPH109 | Heavy chain, S. aureus, Enterococcus | CR6415 | U.S. Pat. No. 8,628,776 SEQ ID NO: 475 | 7338 |
| STPH110 | Heavy chain, S. aureus, Enterococcus | CR6429 | U.S. Pat. No. 8,628,776 SEQ ID NO: 479 | 7339 |
| STPH111 | Heavy chain, S. aureus, S. epidermidis, S. caprae, S. saprophyticus, S. capitis, or methicillin-resistant S. aureus (MRSA) | F1 antibody variant | U.S. Pat. No. 8,617,556 SEQ ID NO: 7 | 7340 |
| STPH112 | Heavy chain, S. aureus, S. epidermidis, S. caprae, S. saprophyticus, S. capitis, or methicillin-resistant S. aureus (MRSA) | F1 antibody variant | U.S. Pat. No. 8,617,556 SEQ ID NO: 9 | 7341 |
| STPH113 | Heavy chain, S. aureus, S. epidermidis, S. caprae, S. saprophyticus, S. capitis, or methicillin-resistant S. aureus (MRSA) | rF1 | U.S. Pat. No. 8,617,556 SEQ ID NO: 55 | 7342 |
| STPH114 | Heavy chain, S. aureus, S. epidermidis, S. caprae, S. saprophyticus, S. capitis, or methicillin-resistant S. aureus (MRSA) | rF1 A114C | U.S. Pat. No. 8,617,556 SEQ ID NO: 56 | 7343 |
| STPH115 | Heavy chain, S. aureus, S. epidermidis, S. caprae, S. saprophyticus, S. capitis, or methicillin-resistant S. aureus (MRSA) | rF1 | U.S. Pat. No. 8,617,556 SEQ ID NO: 63 | 7344 |
| STPH116 | Heavy chain, S. aureus, S. epidermidis, S. caprae, S. saprophyticus, S. capitis, or methicillin-resistant S. aureus (MRSA) | rF1 A114C | U.S. Pat. No. 8,617,556 SEQ ID NO: 62 | 7345 |
| STPH117 | Light chain | | U.S. Pat. No. 8,609,102 SEQ ID NO: 4 | 7346 |
| STPH118 | Light chain variable region, S. aureus | | U.S. Pat. No. 8,609,102 SEQ ID NO: 8 | 7347 |
| STPH119 | Light chain variable region, S. aureus or S. epidermidis, E. coli, Yersinia pestis (Y. pestis), Y. entercolitica, Xanthomnonas axonopodis (X. axonopodis), Pseudonmonas fuorescerns (P. fluorescerns), Actinobacillus actinomycetemcomitans (A. | SAR279356 | U.S. Pat. No. 7,786,255 SEQ ID NO: 2 | 7348 |

TABLE 34-continued

Antibodies against Staphylococcal bacteria and related bacteria

| Antibody No. | Description | Antibody Name | Reference Information | SEQ ID NO |
|---|---|---|---|---|
| | actinomycetemcomitans), A. pleuropneumoniae, Ralstonia solanacearum (R. solanacearum), Bordetella pertussis (B. pertussis), B. parapertussis or B. bronchiseptica | | | |
| STPH120 | Light chain variable region, S. aureus or S. epidermidis, E. coli, Yersinia pestis (Y. pestis), Y. entercolitica, Xanthomnonas axonopodis (X. axonopodis), Pseudonmonas fuorescerns (P. fluorescens), Actinobacillus actinomycetemcomitans (A. actinomycetemcomitans), A. pleuropneumoniae, Ralstonia solanacearum (R. solanacearum), Bordetella pertussis (B. pertussis), B. parapertussis or B. bronchiseptica | SAR279356 | US20110002932 SEQ ID NO: 2 | 7349 |
| STPH121 | Light chain variable region, S. epidermidis | 108-1 | U.S. Pat. No. 8,475,798 SEQ ID NO: 16 | 7350 |
| STPH122 | Light chain variable region, S. epidermidis | 108-36 | U.S. Pat. No. 8,475,798 SEQ ID NO: 20 | 7351 |
| STPH123 | Light chain variable region, S. epidermidis | 110-15 | U.S. Pat. No. 8,475,798 SEQ ID NO: 24 | 7352 |
| STPH124 | Light chain variable region, S. epidermidis | 108-1VL-Hu | U.S. Pat. No. 8,475,798 SEQ ID NO: 27 | 7353 |
| STPH125 | Light chain variable region, S. epidermidis | 108-36VL-Hu | U.S. Pat. No. 8,475,798 SEQ ID NO: 29 | 7354 |
| STPH126 | Light chain variable region, S. epidermidis | 110-15VL-Hu | U.S. Pat. No. 8,475,798 SEQ ID NO: 31 | 7355 |
| STPH127 | Light chain variable region, Staphylococcal sepsis | Pagibaximab | U.S. Pat. No. 8,372,958 SEQ ID NO: 89 | 7356 |
| STPH128 | Light chain variable region, Staphylococcal sepsis | Pagibaximab | U.S. Pat. No. 8,372,958 SEQ ID NO: 10 | 7357 |
| STPH129 | Light chain variable region, Staphylococcal sepsis | Pagibaximab | U.S. Pat. No. 8,372,958 SEQ ID NO: 16 | 7358 |
| STPH130 | Light chain variable region, Staphylococci such as S. aureus and S. epidermidis, E. coli such as E. coli strains O157:H7 and CFT073, Yersinia pestis, Yersinia entercolitica, Xanthomonas axonopodis, Pseudomonas fluorescens (all of which are sequenced species with complete pgaABCD loci), and Actinobacillus actinomycetemcomitans (AA), Actinobacillus pleuropneumoniae (Ap), Ralstonia solanacearum (e.g., megaplasmid form), Bordetella pertussis, Bordetella parapertussis and Bordetella bronchiseptica | F598 | U.S. Pat. No. 8,912,314 SEQ ID NO: 2 | 7359 |
| STPH131 | Light chain variable region, Staphylococci such as S. aureus and S. epidermidis, E. coli such as E. coli strains O157: H7 and CFT073, Yersinia pestis, Yersinia entercolitica, Xanthomonas axonopodis, Pseudomonas fluorescens (all of which are sequenced species with complete pgaABCD loci), and Actinobacillus actinomycetemcomitans (AA), Actinobacillus pleuropneumoniae (Ap), Ralstonia solanacearum (e.g., megaplasmid form), Bordetella pertussis, Bordetella parapertussis and Bordetella bronchiseptica | F628 | U.S. Pat. No. 8,912,314 SEQ ID NO: 4 | 7360 |
| STPH132 | Light chain variable region, Staphylococci such as S. aureus and S. epidermidis, E. coli such as E. coli strains O157:H7 and CFT073, Yersinia pestis, Yersinia entercolitica, Xanthomonas axonopodis, | F630 | U.S. Pat. No. 8,912,314 SEQ ID NO: 6 | 7361 |

TABLE 34-continued

Antibodies against Staphylococcal bacteria and related bacteria

| Antibody No. | Description | Antibody Name | Reference Information | SEQ ID NO |
|---|---|---|---|---|
| | *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | | | |
| STPH133 | Light chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F598 | U.S. Pat. No. 8,912,314 SEQ ID NO: 57 | 7362 |
| STPH134 | Light chain variable region, Staphylococci such as *S. aureus* and *S. epidermidis*, *E. coli* such as *E. coli* strains O157:H7 and CFT073, *Yersinia pestis*, *Yersinia entercolitica*, *Xanthomonas axonopodis*, *Pseudomonas fluorescens* (all of which are sequenced species with complete pgaABCD loci), and *Actinobacillus actinomycetemcomitans* (AA), *Actinobacillus pleuropneumoniae* (Ap), *Ralstonia solanacearum* (e.g., megaplasmid form), *Bordetella pertussis*, *Bordetella parapertussis* and *Bordetella bronchiseptica* | F630 | U.S. Pat. No. 8,912,314 SEQ ID NO: 60 | 7363 |
| STPH135 | Light chain, MRSA, MSSA | 2B2 | U.S. Pat. No. 8,735,554 SEQ ID NO: 2 | 7364 |
| STPH136 | Light chain. MRSA, MSSA | 2G7 | U.S. Pat. No. 8,735,554 SEQ ID NO: 4 | 7365 |
| STPH137 | Light chain, MRSA, MSSA | 3B12 | U.S. Pat. No. 8,735,554 SEQ ID NO: 6 | 7366 |
| STPH138 | Light chain, *S. aureus* | DFLI | U.S. Pat. No. 8,715,673 SEQ ID NO: 1 | 7367 |
| STPH139 | Light chain, *S. aureus* | DF1-DF20 | U.S. Pat. No. 8,715,673 SEQ ID NO: 3 | 7368 |
| STPH140 | Light chain, *S. aureus* and *S. epidermidis* | CR2430 | U.S. Pat. No. 8,460,666 SEQ ID NO: 32 | 7369 |
| STPH141 | Light chain, *S. aureus* and *S. epidermidis* | CR5132 | U.S. Pat. No. 8,460,666 SEQ ID NO: 34 | 7370 |
| STPH142 | Light chain, *S. aureus* and *S. epidermidis* | CR5133 | U.S. Pat. No. 8,460,666 SEQ ID NO: 36 | 7371 |
| STPH143 | Light chain, *S. aureus* and *S. epidermidis* | CR6166 | U.S. Pat. No. 8,460,666 SEQ ID NO: 177 | 7372 |
| STPH144 | Light chain, *S. aureus* and *S. epidermidis* | CR6171 | U.S. Pat. No. 8,460,666 SEQ ID NO: 179 | 7373 |
| STPH145 | Light chain, *S. aureus* and *S. epidermidis* | CR6176 | U.S. Pat. No. 8,460,666 SEQ ID NO: 181 | 7374 |
| STPH146 | Light chain, *S. aureus* and *S. epidermidis* | CR6187 | U.S. Pat. No. 8,460,666 SEQ ID NO: 183 | 7375 |
| STPH147 | Light chain, *S. aureus* and *S. epidermidis* | CR6193 | U.S. Pat. No. 8,460,666 SEQ ID NO: 185 | 7376 |
| STPH148 | Light chain, *S. aureus* and *S. epidermidis* | CR6249 | U.S. Pat. No. 8,460,666 SEQ ID NO: 187 | 7377 |
| STPH149 | Light chain, *S. aureus* and *S. epidermidis* | CR6273 | U.S. Pat. No. 8,460,666 SEQ ID NO: 189 | 7378 |
| STPH150 | Light chain, *S. aureus* and *S. epidermidis* | CR6389 | U.S. Pat. No. 8,460,666 SEQ ID NO: 191 | 7379 |
| STPH151 | Light chain, *S. aureus* and *S. epidermidis* | CR6403 | U.S. Pat. No. 8,460,666 SEQ ID NO: 193 | 7380 |

TABLE 34-continued

Antibodies against Staphylococcal bacteria and related bacteria

| Antibody No. | Description | Antibody Name | Reference Information | SEQ ID NO |
|---|---|---|---|---|
| STPH152 | Light chain, S. aureus and S. epidermidis | CR6406 | U.S. Pat. No. 8,460,666 SEQ ID NO: 195 | 7381 |
| STPH153 | Light chain, S. aureus and S. epidermidis | CR6410 | U.S. Pat. No. 8,460,666 SEQ ID NO: 197 | 7382 |
| STPH154 | Light chain, S. aureus and S. epidermidis | CR6446 | U.S. Pat. No. 8,460,666 SEQ ID NO: 199 | 7383 |
| STPH155 | Light chain, S. aureus and S. epidermidis | CR6450 | U.S. Pat. No. 8,460,666 SEQ ID NO: 201 | 7384 |
| STPH156 | Light chain, S. aureus and S. epidermidis | CR6452 | U.S. Pat. No. 8,460,666 SEQ ID NO: 203 | 7385 |
| STPH157 | Light chain, S. aureus and S. epidermidis | CR6453 | U.S. Pat. No. 8,460,666 SEQ ID NO: 205 | 7386 |
| STPH158 | Light chain, S. aureus and S. epidermidis | CR6464 | U.S. Pat. No. 8,460,666 SEQ ID NO: 207 | 7387 |
| STPH159 | Light chain, S. aureus and S. epidermidis | CR6471 | U.S. Pat. No. 8,460,666 SEQ ID NO: 209 | 7388 |
| STPH160 | Light chain, S. aureus and S. epidermidis | CR6516 | U.S. Pat. No. 8,460,666 SEQ ID NO: 211 | 7389 |
| STPH161 | Light chain, S. aureus and S. epidermidis | CR6517 | U.S. Pat. No. 8,460,666 SEQ ID NO: 213 | 7390 |
| STPH162 | Light chain, S. aureus and S. epidermidis | CR6526 | U.S. Pat. No. 8,460,666 SEQ ID NO: 215 | 7391 |
| STPH163 | Light chain, S. aureus and S. epidermidis | CR6528 | U.S. Pat. No. 8,460,666 SEQ ID NO: 217 | 7392 |
| STPH164 | Light chain, S. aureus and S. epidermidis | CR6531 | U.S. Pat. No. 8,460,666 SEQ ID NO: 219 | 7393 |
| STPH165 | Light chain, S. aureus and S. epidermidis | CR6533 | U.S. Pat. No. 8,460,666 SEQ ID NO: 221 | 7394 |
| STPH166 | Light chain, S. aureus and S. epidermidis | CR6536 | U.S. Pat. No. 8,460,666 SEQ ID NO: 223 | 7395 |
| STPH167 | Light chain, S. aureus and S. epidermidis | CR6537 | U.S. Pat. No. 8,460,666 SEQ ID NO: 225 | 7396 |
| STPH168 | Light chain, S. aureus and S. epidermidis | CR6538 | U.S. Pat. No. 8,460,666 SEQ ID NO: 227 | 7397 |
| STPH169 | Light chain, S. aureus and S. epidermidis | CR6540 | U.S. Pat. No. 8,460,666 SEQ ID NO: 229 | 7398 |
| STPH170 | Light chain, S. aureus and S. epidermidis | CR6544 | U.S. Pat. No. 8,460,666 SEQ ID NO: 231 | 7399 |
| STPH171 | Light chain, S. aureus and S. epidermidis | CR6566 | U.S. Pat. No. 8,460,666 SEQ ID NO: 233 | 7400 |
| STPH172 | Light chain, S. aureus and S. epidermidis | CR6625 | U.S. Pat. No. 8,460,666 SEQ ID NO: 235 | 7401 |
| STPH173 | Light chain, S. aureus, Enterococcus | CR6157 | U.S. Pat. No. 8,628,776 SEQ ID NO: 397 | 7402 |
| STPH174 | Light chain, S. aureus, Enterococcus | CR5166 | U.S. Pat. No. 8,628,776 SEQ ID NO: 84 | 7403 |
| STPH175 | Light chain, S. aureus, Enterococcus | CR5187 | U.S. Pat. No. 8,628,776 SEQ ID NO: 86 | 7404 |
| STPH176 | Light chain, S. aureus, Enterococcus | CR6043 | U.S. Pat. No. 8,628,776 SEQ ID NO: 90 | 7405 |
| STPH177 | Light chain, S. aureus, Enterococcus | CR6050 | U.S. Pat. No. 8,628,776 SEQ ID NO: 401 | 7406 |
| STPH178 | Light chain, S. aureus, Enterococcus | CR6077 | U.S. Pat. No. 8,628,776 SEQ ID NO: 403 | 7407 |
| STPH179 | Light chain, S. aureus, Enterococcus | CR6079 | U.S. Pat. No. 8,628,776 SEQ ID NO: 405 | 7408 |
| STPH180 | Light chain, S. aureus, Enterococcus | CR6087 | U.S. Pat. No. 8,628,776 SEQ ID NO: 211 | 7409 |
| STPH181 | Light chain, S. aureus, Enterococcus | CR6092 | U.S. Pat. No. 8,628,776 SEQ ID NO: 409 | 7410 |
| STPH182 | Light chain, S. aureus, Enterococcus | CR6195 | U.S. Pat. No. 8,628,776 SEQ ID NO: 413 | 7411 |
| STPH183 | Light chain, S. aureus, Enterococcus | CR6241 | U.S. Pat. No. 8,628,776 SEQ ID NO: 98 | 7412 |
| STPH184 | Light chain, S. aureus, Enterococcus | CR6246 | U.S. Pat. No. 8,628,776 SEQ ID NO: 419 | 7413 |
| STPH185 | Light chain, S. aureus, Enterococcus | CR6388 | U.S. Pat. No. 8,628,776 SEQ ID NO: 421 | 7414 |
| STPH186 | Light chain, S. aureus, Enterococcus | CR6396 | U.S. Pat. No. 8,628,776 SEQ ID NO: 425 | 7415 |
| STPH187 | Light chain, S. aureus, Enterococcus | CR6409 | U.S. Pat. No. 8,628,776 SEQ ID NO: 429 | 7416 |
| STPH188 | Light chain, S. aureus, Enterococcus | CR6421 | U.S. Pat. No. 8,628,776 SEQ ID NO: 433 | 7417 |

TABLE 34-continued

Antibodies against Staphylococcal bacteria and related bacteria

| Antibody No. | Description | Antibody Name | Reference Information | SEQ ID NO |
|---|---|---|---|---|
| STPH189 | Light chain, *S. aureus*, *Enterococcus* | CR6432 | U.S. Pat. No. 8,628,776 SEQ ID NO: 437 | 7418 |
| STPH190 | Light chain, *S. aureus*, *Enterococcus* | CR5157 | U.S. Pat. No. 8,628,776 SEQ ID NO: 441 | 7419 |
| STPH191 | Light chain, *S. aureus*, *Enterococcus* | CR5166 | U.S. Pat. No. 8,628,776 SEQ ID NO: 104 | 7420 |
| STPH192 | Light chain, *S. aureus*, *Enterococcus* | CR5187 | U.S. Pat. No. 8,628,776 SEQ ID NO: 106 | 7421 |
| STPH193 | Light chain, *S. aureus*, *Enterococcus* | CR6043 | U.S. Pat. No. 8,628,776 SEQ ID NO: 110 | 7422 |
| STPH194 | Light chain, *S. aureus*, *Enterococcus* | CR6050 | U.S. Pat. No. 8,628,776 SEQ ID NO: 445 | 7423 |
| STPH195 | Light chain, *S. aureus*, *Enterococcus* | CR6077 | U.S. Pat. No. 8,628,776 SEQ ID NO: 447 | 7424 |
| STPH196 | Light chain, *S. aureus*, *Enterococcus* | CR6079 | U.S. Pat. No. 8,628,776 SEQ ID NO: 449 | 7425 |
| STPH197 | Light chain, *S. aureus*, *Enterococcus* | CR6087 | U.S. Pat. No. 8,628,776 SEQ ID NO: 215 | 7426 |
| STPH198 | Light chain, *S. aureus*, *Enterococcus* | CR6092 | U.S. Pat. No. 8,628,776 SEQ ID NO: 453 | 7427 |
| STPH199 | Light chain, *S. aureus*, *Enterococcus* | CR6195 | U.S. Pat. No. 8,628,776 SEQ ID NO: 457 | 7428 |
| STPH200 | Light chain, *S. aureus*, *Enterococcus* | CR6241 | U.S. Pat. No. 8,628,776 SEQ ID NO: 118 | 7429 |
| STPH201 | Light chain, *S. aureus*, *Enterococcus* | CR6246 | U.S. Pat. No. 8,628,776 SEQ ID NO: 463 | 7430 |
| STPH202 | Light chain, *S. aureus*, *Enterococcus* | CR6388 | U.S. Pat. No. 8,628,776 SEQ ID NO: 465 | 7431 |
| STPH203 | Light chain, *S. aureus*, *Enterococcus* | CR6396 | U.S. Pat. No. 8,628,776 SEQ ID NO: 469 | 7432 |
| STPH204 | Light chain, *S. aureus*, *Enterococcus* | CR6409 | U.S. Pat. No. 8,628,776 SEQ ID NO: 473 | 7433 |
| STPH205 | Light chain, *S. aureus*, *Enterococcus* | CR6421 | U.S. Pat. No. 8,628,776 SEQ ID NO: 477 | 7434 |
| STPH206 | Light chain, *S. aureus*, *Enterococcus* | CR6432 | U.S. Pat. No. 8,628,776 SEQ ID NO: 481 | 7435 |
| STPH207 | Light chain, *S. aureus*, *S. epidermidis*, *S. caprae*, *S. saprophyticus*, *S. capitis*, or methicillin-resistant *S. aureus* (MRSA) | F1 antibody variant | U.S. Pat. No. 8,617,556 SEQ ID NO: 8 | 7436 |
| STPH208 | Light chain, *S. aureus*, *S. epidermidis*, *S. caprae*, *S. saprophyticus*, *S. capitis*, or methicillin-resistant *S. aureus* (MRSA) | F1 antibody variant | U.S. Pat. No. 8,617,556 SEQ ID NO: 10 | 7437 |
| STPH209 | Light chain, *S. aureus*, *S. epidermidis*, *S. caprae*, *S. saprophyticus*, *S. capitis*, or methicillin-resistant *S. aureus* (MRSA) | F1 antibody variant | U.S. Pat. No. 8,617,556 SEQ ID NO: 11 | 7438 |
| STPH210 | Light chain, *S. aureus*, *S. epidermidis*, *S. caprae*, *S. saprophyticus*, *S. capitis*, or methicillin-resistant *S. aureus* (MRSA) | rF1 | U.S. Pat. No. 8,617,556 SEQ ID NO: 57 | 7439 |
| STPH211 | Light chain, *S. aureus*, *S. epidermidis*, *S. caprae*, *S. saprophyticus*, *S. capitis*, or methicillin-resistant *S. aureus* (MRSA) | rF1 V205C | U.S. Pat. No. 8,617,556 SEQ ID NO: 58 | 7440 |
| STPH212 | Light chain, *S. aureus*, *S. epidermidis*, *S. caprae*, *S. saprophyticus*, *S. capitis*, or methicillin-resistant *S. aureus* (MRSA) | rF1 | U.S. Pat. No. 8,617,556 SEQ ID NO: 64 | 7441 |
| STPH213 | ScFv, *S. aureus* and *S. epidermidis* | SC02-430 | U.S. Pat. No. 8,460,666 SEQ ID NO: 20 | 7442 |
| STPH214 | ScFv, *S. aureus* and *S. epidermidis* | SC05-132 | U.S. Pat. No. 8,460,666 SEQ ID NO: 22 | 7443 |
| STPH215 | ScFv, *S. aureus* and *S. epidermidis* | SC05-133 | U.S. Pat. No. 8,460,666 SEQ ID NO: 24 | 7444 |
| STPH216 | ScFv, *S. aureus*, *Enterococcus* | SC05-140 | U.S. Pat. No. 8,628,776 SEQ ID NO: 351 | 7445 |
| STPH217 | ScFv, *S. aureus*, *Enterococcus* | SC05-157 | U.S. Pat. No. 8,628,776 SEQ ID NO: 353 | 7446 |
| STPH218 | ScFv, *S. aureus*, *Enterococcus* | SC05-159 | U.S. Pat. No. 8,628,776 SEQ ID NO: 62 | 7447 |
| STPH219 | ScFv, *S. aureus*, *Enterococcus* | SC05-166 | U.S. Pat. No. 8,628,776 SEQ ID NO: 64 | 7448 |
| STPH220 | ScFv, *S. aureus*, *Enterococcus* | SC05-179 | U.S. Pat. No. 8,628,776 SEQ ID NO: 355 | 7449 |
| STPH221 | ScFv, *S. aureus*, *Enterococcus* | SC05-187 | U.S. Pat. No. 8,628,776 SEQ ID NO: 66 | 7450 |
| STPH222 | ScFv, *S. aureus*, *Enterococcus* | SC06-016 | U.S. Pat. No. 8,628,776 SEQ ID NO: 68 | 7451 |

TABLE 34-continued

Antibodies against Staphylococcal bacteria and related bacteria

| Antibody No. | Description | Antibody Name | Reference Information | SEQ ID NO |
|---|---|---|---|---|
| STPH223 | ScFv, *S. aureus*, *Enterococcus* | SC06-043 | U.S. Pat. No. 8,628,776 SEQ ID NO: 70 | 7452 |
| STPH224 | ScFv, *S. aureus*, *Enterococcus* | SC06-049 | U.S. Pat. No. 8,628,776 SEQ ID NO: 72 | 7453 |
| STPH225 | ScFv, *S. aureus*, *Enterococcus* | SC06-050 | U.S. Pat. No. 8,628,776 SEQ ID NO: 357 | 7454 |
| STPH226 | ScFv, *S. aureus*, *Enterococcus* | SC06-071 | U.S. Pat. No. 8,628,776 SEQ ID NO: 74 | 7455 |
| STPH227 | ScFv, *S. aureus*, *Enterococcus* | SC06-077 | U.S. Pat. No. 8,628,776 SEQ ID NO: 359 | 7456 |
| STPH228 | ScFv, *S. aureus*, *Enterococcus* | SC06-078 | U.S. Pat. No. 8,628,776 SEQ ID NO: 76 | 7457 |
| STPH229 | ScFv, *S. aureus*, *Enterococcus* | SC06-079 | U.S. Pat. No. 8,628,776 SEQ ID NO: 361 | 7458 |
| STPH230 | ScFv, *S. aureus*, *Enterococcus* | SC06-086 | U.S. Pat. No. 8,628,776 SEQ ID NO: 363 | 7459 |
| STPH231 | ScFv, *S. aureus*, *Enterococcus* | SC06-087 | U.S. Pat. No. 8,628,776 SEQ ID NO: 207 | 7460 |
| STPH232 | ScFv, *S. aureus*, *Enterococcus* | SC06-089 | U.S. Pat. No. 8,628,776 SEQ ID NO: 209 | 7461 |
| STPH233 | ScFv, *S. aureus*, *Enterococcus* | SC06-092 | U.S. Pat. No. 8,628,776 SEQ ID NO: 365 | 7462 |
| STPH234 | ScFv, *S. aureus*, *Enterococcus* | SC06-091 | U.S. Pat. No. 8,628,776 SEQ ID NO: 367 | 7463 |
| STPH235 | ScFv, *S. aureus*, *Enterococcus* | SC06-195 | U.S. Pat. No. 8,628,776 SEQ ID NO: 369 | 7464 |
| STPH236 | ScFv, *S. aureus*, *Enterococcus* | SC06-198 | U.S. Pat. No. 8,628,776 SEQ ID NO: 371 | 7465 |
| STPH237 | ScFv, *S. aureus*, *Enterococcus* | SC06-241 | U.S. Pat. No. 8,628,776 SEQ ID NO: 78 | 7466 |
| STPH238 | ScFv, *S. aureus*, *Enterococcus* | SC06-242 | U.S. Pat. No. 8,628,776 SEQ ID NO: 373 | 7467 |
| STPH239 | ScFv, *S. aureus*, *Enterococcus* | SC06-246 | U.S. Pat. No. 8,628,776 SEQ ID NO: 375 | 7468 |
| STPH240 | ScFv, *S. aureus*, *Enterococcus* | SC06-252 | U.S. Pat. No. 8,628,776 SEQ ID NO: 80 | 7469 |
| STPH241 | ScFv, *S. aureus*, *Enterococcus* | SC06-388 | U.S. Pat. No. 8,628,776 SEQ ID NO: 377 | 7470 |
| STPH242 | ScFv, *S. aureus*, *Enterococcus* | SC06-389 | U.S. Pat. No. 8,628,776 SEQ ID NO: 379 | 7471 |
| STPH243 | ScFv, *S. aureus*, *Enterococcus* | SC06-396 | U.S. Pat. No. 8,628,776 SEQ ID NO: 381 | 7472 |
| STPH244 | ScFv, *S. aureus*, *Enterococcus* | SC06-402 | U.S. Pat. No. 8,628,776 SEQ ID NO: 383 | 7473 |
| STPH245 | ScFv, *S. aureus*, *Enterococcus* | SC06-409 | U.S. Pat. No. 8,628,776 SEQ ID NO: 385 | 7474 |
| STPH246 | ScFv, *S. aureus*, *Enterococcus* | SC06-415 | U.S. Pat. No. 8,628,776 SEQ ID NO: 387 | 7475 |
| STPH247 | ScFv, *S. aureus*, *Enterococcus* | SC06-421 | U.S. Pat. No. 8,628,776 SEQ ID NO: 389 | 7476 |
| STPH248 | ScFv, *S. aureus*, *Enterococcus* | SC06-429 | U.S. Pat. No. 8,628,776 SEQ ID NO: 391 | 7477 |
| STPH249 | ScFv, *S. aureus*, *Enterococcus* | SC06-432 | U.S. Pat. No. 8,628,776 SEQ ID NO: 393 | 7478 |

In one embodiment, the payload region of the AAV particle comprises one or more nucleic acid sequences, fragment or variants thereof or encodes one or more polypeptides, fragments or variants thereof described in International Publication No. WO2000071585, WO2013162751, WO2015089502, WO2015088346 (e.g., SEQ ID NO: 17), US Pub No. US20030224000, US20080014202, US20140037650, US20140170134, U.S. Pat. No. 8,460, 666, the contents of each of which are herein incorporated by reference in their entirety, against *Staphylococcus* infection.

In one embodiment, the payload region of the AAV particle comprises one or more nucleic acid sequences encoding one or more of the payload antibody polypeptides listed in Table 35 against *Clostridium tetani*.

TABLE 35

Antibodies against *Clostridium Tetani*

| Antibody No. | Description | Antibody Name | Reference Information | SEQ ID NO |
|---|---|---|---|---|
| CTET1 | Heavy chain partial | | Sims, G. P. "Tetanus toxoid specific antibody heavy chain V-gene sequence", Unpublished, CNBI Accession # AAC69189.1 | 7479 |
| CTET2 | Heavy chain variable region | F5-20 | Sims, G. P. "Tetanus toxoid specific antibody heavy chain V-gene sequence", Unpublished, CNBI Accession # AAB50736.1 | 7480 |
| CTET3 | Heavy chain variable region | | Larrick, J. W., "Therapeutic human antibodies derived from PCR amplification of B-cell variable regions", Immunol. Rev. 130, 69-85 (1992), CNBI Accession # AAB25318.1 | 7481 |
| CTET4 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36976.1 | 7482 |
| CTET5 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36975.1 | 7483 |
| CTET6 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36974.1 | 7484 |
| CTET7 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36973.1 | 7485 |
| CTET8 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36972.1 | 7486 |
| CTET9 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36971.1 | 7487 |
| CTET10 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36970.1 | 7488 |
| CTET11 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36969.1 | 7489 |
| CTET12 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36968.1 | 7490 |
| CTET13 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol, Biol, 387 (3), 548-558 (2009), CNBI Accession # ACL36967.1 | 7491 |
| CTET14 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36966.1 | 7492 |
| CTET15 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36965.1 | 7493 |
| CTET16 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36964.1 | 7494 |
| CTET17 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36963.1 | 7495 |
| CTET18 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36962.1 | 7496 |
| CTET19 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36961.1 | 7497 |

TABLE 35-continued

Antibodies against *Clostridium Tetani*

| Antibody No. | Description | Antibody Name | Reference Information | SEQ ID NO |
|---|---|---|---|---|
| CTET20 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36960.1 | 7498 |
| CTET21 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36958.1 | 7499 |
| CTET22 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36959.1 | 7500 |
| CTET23 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36957.1 | 7501 |
| CTET24 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36956.1 | 7502 |
| CTET25 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36955.1 | 7503 |
| CTET26 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36954.1 | 7504 |
| CTET27 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36953.1 | 7505 |
| CTET28 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36952.1 | 7506 |
| CTET29 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36951.1 | 7507 |
| CTET30 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36950.1 | 7508 |
| CTET31 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36949.1 | 7509 |
| CTET32 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36948.1 | 7510 |
| CTET33 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36947.1 | 7511 |
| CTET34 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36946.1 | 7512 |
| CTET35 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36924.1 | 7513 |
| CTET36 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36925.1 | 7514 |
| CTET37 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36926.1 | 7515 |
| CTET38 | Heavy chain variable region, | | de Kruif, J. et al., "Human immunoglobulin repertoires against tetanus toxoid contain a large and diverse fraction | 7516 |

TABLE 35-continued

Antibodies against *Clostridium Tetani*

| Antibody No. | Description | Antibody Name | Reference Information | SEQ ID NO |
|---|---|---|---|---|
| | Human immunoglobulin | | of high-affinity promiscuous V(H) genes", J. Mol. Biol. 387 (3), 548-558 (2009), CNBI Accession # ACL36927.1 | |
| CTET39 | Heavy chain variable region, Human immunoglobulin | | de Kruif, J. et al., "Human immunoglobulin repertoires against tetanus toxoid contain a large and diverse fraction of high-affinity promiscuous V(H) genes", J, Mol. Biol. 387 (3), 548-558 (2009), CNBI Accession # ACL36928.1 | 7517 |
| CTET40 | Heavy chain variable region, Human immunoglobulin | | de Kruif, J. et al., "Human immunoglobulin repertoires against tetanus toxoid contain a large and diverse fraction of high-affinity promiscuous V(H) genes", J, Mol. Biol. 387 (3), 548-558 (2009), CNBI Accession # ACL36929.1 | 7518 |
| CTET41 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36930.1 | 7519 |
| CTET42 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36931.1 | 7520 |
| CTET43 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36932.1 | 7521 |
| CTET44 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36933.1 | 7522 |
| CTET45 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36934.1 | 7523 |
| CTET46 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36935.1 | 7524 |
| CTET47 | Heavy chain variable region, Human immunoglobulin | | de Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36936.1 | 7525 |
| CTET48 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36937.1 | 7526 |
| CTET49 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36938.1 | 7527 |
| CTET50 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36939.1 | 7528 |
| CTET51 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36940.1 | 7529 |
| CTET52 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36941.1 | 7530 |
| CTET53 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36943.1 | 7531 |
| CTET54 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36942.1 | 7532 |
| CTET55 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36944.1 | 7533 |
| CTET56 | Heavy chain variable region, Human immunoglobulin | | e Kruif, J. et al., "Human immunoglobulin repertoires against tetanus toxoid contain a large and diverse fraction of high-affinity promiscuous V(H) genes", J. Mol. Biol. 387 (3), 548-558 (2009), CNBI Accession # ACL36945.1 | 7534 |

TABLE 35-continued

Antibodies against *Clostridium Tetani*

| Antibody No. | Description | Antibody Name | Reference Information | SEQ ID NO |
|---|---|---|---|---|
| CTET57 | Light chain variable region | | Larrick, J. W.. "Therapeutic human antibodies derived from PCR amplification of B-cell variable regions", Immunol. Rev. 130, 69-85 (1992), CNBI Accession # AAB25319.1 | 7535 |

In one embodiment, the payload region of the AAV particle comprises one or more nucleic acid sequences encoding one or more of the payload antibody polypeptides listed in Table 36 against *Bordetella pertussis* and/or *Bordetella parapertussis*.

TABLE 36

Antibodies against *Bordetella Pertussis* and *Bordetella Parapertussis*

| Antibody No. | Description | Antibody Name | Reference information | SEQ ID NO |
|---|---|---|---|---|
| BORT1 | Heavy chain | 42.1 1.D4 | WO2014160098 SEQ ID NO: 47 | 7536 |
| BORT2 | Heavy chain | 42.12.G2 | WO2014160098 SEQ ID NO: 51 | 7537 |
| BORT3 | Heavy chain | 42.12.A12 | WO2014160098 SEQ ID NO: 55 | 7538 |
| BORT4 | Heavy chain | 42.12.A9 | WO2014160098 SEQ ID NO: 59 | 7539 |
| BORT5 | Heavy chain | 42.18.E12 | WO2014160098 SEQ ID NO: 63 | 7540 |
| BORT6 | Heavy chain | 55.12.A8 | WO2014160098 SEQ ID NO: 67 | 7541 |
| BORT7 | Heavy chain | 55.15.H5 | WO2014160098 SEQ ID NO: 71 | 7542 |
| BORT8 | Heavy chain | 55.17.D8 | WO2014160098 SEQ ID NO: 75 | 7543 |
| BORT9 | Heavy chain | 55.22.E7 | WO2014160098 SEQ ID NO: 79 | 7544 |
| BORT10 | Light chain | 42,1 1.D4 | WO2014160098 SEQ ID NO: 49 | 7545 |
| BORT11 | Light chain | 42.12.G2 | WO2014160098 SEQ ID NO: 53 | 7546 |
| BORT12 | Light chain | 42.12.A12 | WO2014160098 SEQ ID NO: 57 | 7547 |
| BORT13 | Light chain | 42.12.A9 | WO2014160098 SEQ ID NO: 61 | 7548 |
| BORT14 | Light chain | 42.18.E12 | WO2014160098 SEQ ID NO: 65 | 7549 |
| BORT15 | Light chain | 55.12.A8 | WO2014160098 SEQ ID NO: 69 | 7550 |
| BORT16 | Light chain | 55.15.H5 | WO2014160098 SEQ ID NO: 73 | 7551 |
| BORT17 | Light chain | 55.17.D8 | WO2014160098 SEQ ID NO: 77 | 7552 |
| BORT18 | Light chain | 55.22.E7 | WO2014160098 SEQ ID NO: 81 | 7553 |
| BORT19 | Single chain variable fragment antibody type 1 a1, single chain variable region | | Hussein, A. H. et al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13478.1 | 7554 |
| BORT20 | Single chain variable fragment antibody type 18 a18, single chain variable region | | Hussein, A. H. et al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13483.1 | 7555 |
| BORT21 | Single chain variable fragment antibody type 2 a2, single chain variable region | | Hussein, A. H, el al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13479.1 | 7556 |
| BORT22 | Single chain variable fragment antibody type 4 b4, single chain variable region | | Hussein, A. H. et al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13480.1 | 7557 |
| BORT23 | Single chain variable fragment antibody type 5 c5, single chain variable region | | Hussein, A. H. et al. "Construction and characterization of single-chain variable fragment antibodies directed against the *Bordetella pertussis* surface adhesins filamentous hemagglutinin and pertactin" | 7558 |

TABLE 36-continued

Antibodies against *Bordetella Pertussis* and *Bordetella Parapertussis*

| Antibody No. | Description | Antibody Name | Reference information | SEQ ID NO |
|---|---|---|---|---|
| BORT24 | Single chain variable fragment antibody type 6 d6, single chain variable region | | Infect. Immun. 75 (11), 5476-5482 (2007), NCBI Accession # ABB13481.1 Hussein, A. H. et al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13482.1 | 7559 |
| BORT25 | Single chain variable fragment antibody type 7 e, single chain variable region | | Hussein, A. H. et al. "Construction and characterization of single-chain variable fragment antibodies directed against the *Bordetella pertussis* surface adhesins filamentous hemagglutinin and pertactin" Infect. Immun. 75 (11), 5476-5482 (2007), NCBI Accession # ABB13484.1 | 7560 |

In one embodiment, the payload region of the AAV particle comprises one or more nucleic acid sequences encoding one or more of the payload antibody polypeptides listed in Table 37 against Mycobacteria In one embodiment, the payload region of the AAV particle comprises one or more nucleic acid sequences encoding one or more of the payload antibody polypeptides listed in Table 38 against *Francisella tularensis*.

TABLE 37

Antibodies against Mycobacteria

| Antibody No, | Description | Antibody Name | Reference Information | SEQ ID NO |
|---|---|---|---|---|
| MYCO1 | Autod2 Single-chain variable fragment antibody, Tb antibody, anti-neutrophil cytoplasmic antibodies cross-react with *mycobacterium avium* subsp. *Paratuberculosis* antigens | | Berger et al., Microbes Infect, 9 (8), 963-970 (2007), NCBI Accession # ABI81486.1 | 7561 |
| MYCO2 | autoh1 single-chain variable fragment antibody, Tb antibody, anti-neutrophil cytoplasmic antibodies cross-react with *mycobacterium avium* subsp. *Paratuberculosis* antigens, | | Berger et al., Microbes Infect. 9 (8), 963-970 (2007), NCBI Accession # ABI81485.1 | 7562 |
| MYCO3 | Heavy chain constant region, Mycobacteria | moG2a/ moG2afull | US20130309237 SEQ ID NO: 10 | 7563 |
| MYCO4 | Heavy chain constant region, Mycobacteria | hG1mG2a | US20130309237 SEQ ID NO: 11 | 7564 |
| MYCO5 | Heavy chain constant region, Mycobacteria | hG3mG2a | US20130309237 SEQ ID NO: 12 | 7565 |
| MYCO6 | Heavy chain constant region, Mycobacteria | huG1full | US20130309237 SEQ ID NO: 13 | 7566 |
| MYCO7 | Heavy chain constant region, Mycobacteria | huG3full | US20130309237 SEQ ID NO: 14 | 7567 |
| MYCO8 | Heavy chain variable region, Mycobacteria | 2F12 IgGs | US20130309237 SEQ ID NO: 15 | 7568 |
| MYCO9 | Heavy chain variable region, Mycobacteria | 2F12 IgGs | US20130309237 SEQ ID NO: 18 | 7569 |
| MYCO10 | Heavy chain variable region, partial sequence, Tb antibody, mouse monoclonal mpt51 | 16a1 | Al-sayyed et al., Tuberculosis (Edinb) 87 (6), 489-497 (2007), NCBI Accession # ABS20005.1 | 7570 |
| MYCO11 | Light chain constant region, Mycobacteria | HuCK | US20130309237 SEQ ID NO: 16 | 7571 |
| MYCO12 | Light chain variable region, Mycobacteria | MoCK | US20130309237 SEQ ID NO: 17 | 7572 |
| MYCO13 | Light chain variable region, partial sequence, Tb antibody, mouse monoclonal mpt51 | 16a1 | Al-sayyed el al., Tuberculosis (Edinb) 87 (6), 489-497 (2007), NCBI Accession # ABS20006.1 | 7573 |
| MYC014 | Scfv, Tb antibody, an engineered single chain antibody | | US20060229438 SEQ ID NO: 3 | 7574 |
| MYC015 | Scfv, Tb antibody, an engineered single chain antibody | | US20060229438 SEQ ID NO: 4 | 7575 |
| MYC016 | Scfv, Tb antibody, an engineered single chain antibody | | US20060229438 SEQ ID NO: 2 | 7576 |

TABLE 38

Antibodies against *Francisella Tularensis*

| Antibody No. | Description | Antibody Name | Reference Information | SEQ ID NO |
|---|---|---|---|---|
| FRAN1 | Chain H | Ab-52 | Rynkiewicz, M. J. et al., "Structural Analysis of a Protective Epitope of the *Francisella tularensis* O-Polysaccharide", Biochemistry- 51 (28), 5684-5694 (2012), NCBI Accession # 3UJT_H | 7577 |
| FRAN2 | Chain H | N62 | Lu, Z., et al., "The binding sites of monoclonal antibodies to the non-reducing end of *Francisella tularensis* O-antigen accommodate mainly the terminal saccharide", Immunology 140 (3), 374-389 (2013), NCBI Accession # 4KPH_H | 7578 |
| FRAN3 | Chain H | Ab64 | Lu, Z. et al., "B-cell epitopes in GroEL of *Francisella tularensis*", PLoS ONE 9 (6), E99847 (2014), NCBI Accession # 4PB9_H | 7579 |
| FRAN4 | Chain H | Ab53 | Lu, Z., et al., "B-cell epitopes in GroEL of *Francisella tularensis*", PLoS ONE 9 (6), E99847 (2014), NCBI Accession # 4PB0_H | 7580 |
| FRAN5 | Chain H | N203 | Lu, Z. et al., "Functional and Structural Characterization of *Francisella tularensis* O-Antigen Antibodies at the Low End of Antigen Reactivity", Monoclonal Antib Immunodiagn Immunother 33 (4), 235-245 (2014), NCBI Accession # 4OTX_H | 7581 |
| FRAN6 | Chain I | Ab-52 | Rynkiewicz, M. J., et al., "Structural Analysis of a Protective Epitope of the *Francisella tularensis* O-Polysaccharide", Biochemistry 51 (28), 5684-5694 (2012), NCBI Accession # 3UJT_I | 7582 |
| FRAN7 | Chain I | N62 | Lu, Z., et al., "The binding sites of monoclonal antibodies to the non-reducing end of *Francisella tularensis* O-antigen accommodate mainly the terminal saccharide", Immunology 140 (3), 374-389 (2013), NCBI Accession # 4KPH_I | 7583 |
| FRAN8 | Chain I | N203 | Lu, Z. et al., "Functional and Structural Characterization of *Francisella tularensis* O-Antigen Antibodies at the Low End of Antigen Reactivity", Monoclonal Antib Immunodiagn Immunother 33 (4), 235-245 (2014), NCBI Accession # 4OTX_I | 7584 |
| FRAN9 | Chain L | Ab-52 | Rynkiewicz, M. J., et al., "Structural Analysis of a Protective Epitope of the *Francisella tularensis* O-Polysaccharide", Biochemistry 51 (28), 5684-5694 (2012), NCBI Accession # 3UJT_L | 7585 |
| FRAN10 | Chain L | N62 | Lu, Z., et al., "The binding sites of monoclonal antibodies to the non-reducing end of *Francisella tularensis* O-antigen accommodate mainly the terminal saccharide", Immunology 140 (3), 374-389 (2013), NCBI Accession # 4KPH_L | 7586 |
| FRAN11 | Chain L | Ab64 | Lu, Z. et al., "B-cell epitopes in GroEL of *Francisella tularensis*", PLoS ONE 9 (6), E99847 (2014), NCBI Accession # 4PB9_L | 7587 |
| FRAN12 | Chain L | Ab53 | Lu, Z. et al., "B-cell epitopes in GroEL of *Francisella tularensis*", PLoS ONE 9 (6), E99847 (2014), NCBI Accession # 4PB0_L | 7588 |
| FRAN13 | Chain L | N203 | Lu, Z. et al., "Functional and Structural Characterization of *Francisella tularensis* O-Antigen Antibodies at the Low End of Antigen Reactivity", Monoclonal Antib Immunodiagn Immunother 33 (4), 235-245 (2014), NCBI Accession # 4OTX_L | 7589 |
| FRAN14 | Chain M | Ab-52 | Rynkiewicz, M. J. et al., "Structural Analysis of a Protective Epitope of the *Francisella tularensis* O-Polysaccharide", Biochemistry 51 (28), 5684-5694 (2012), NCBI Accession # 3UJT_M | 7590 |
| FRAN15 | Chain M | N62 | Lu, Z., et al., "The binding sites of monoclonal antibodies to the non-reducing end of *Francisella tularensis* O-antigen accommodate mainly the terminal saccharide", Immunology 140 (3), 374-389 (2013), NCBI Accession # 4KPH_M | 7591 |
| FRAN16 | Chain M | N203 | Lu, Z, et al., "Functional and Structural Characterization of *Francisella tularensis* O-Antigen Antibodies at the Low End of Antigen Reactivity", Monoclonal Antib Immunodiagn Immunother 33 (4), 235-245 (2014), NCBI Accession # 4OTX_M | 7592 |

In one embodiment, the payload region of the AAV particle comprises one or more nucleic acid sequences encoding one or more of the payload antibody polypeptides listed in Table 39 against Bacteria.

TABLE 39

Antibodies against Bacteria

| Antibody No. | Description | Antibody Name | Reference Information | SEQ ID NO |
|---|---|---|---|---|
| BACI1 | Heavy chain variable region, *Enterococcus faecium, Enterococcus faecalis, Clostridium difficile* | | US20080038266 SEQ ID NO: 1 | 7593 |
| BACI2 | Heavy chain variable region, *Neisseria meningitidis*, | Naid60 | US20060073139 SEQ ID NO: 5 | 7594 |
| BACI3 | Heavy chain, *Neisseria meningitidis*, | | Fernandez de Cossio, M. E., et al. "Human monoclonal antibodies against an epitope on the class 5c outer membrane protein common to many pathogenic strains of *Neisseria meningitidis*", J. Infect. Dis. 166 (6), 1322-1328 (1992), AAB18935 | 7595 |
| BACI4 | Heavy chain, *Neisseria meningitidis*, | | Fernandez de Cossio, M. E., et al. "Human monoclonal antibodies against an epitope on the class 5c outer membrane protein common to many pathogenic strains of *Neisseria meningitidis*", J. Infect. Dis. 166 (6), 1322-1328 (1992), AAB18934 | 7596 |
| BACI5 | Heavy chain, Septic shock, meningococcal septic shock | Edobacomab, E5, XMMEN-0E5 | | 7597 |
| BACI6 | Ig kappa chain V-I region WEA, *Klebsiella* bacteria | | Goni, F. and Frangione, B., "Amino acid sequence of the Fv region of a human monoclonal IgM (protein WEA) with antibody activity against 3,4-pyruvylated galactose in *Klebsiella* polysaccharides K30 and K33", Proc. Natl. Acad. Sci. U.S.A. 80 (15), 4837-4841 (1983). P01610 | 7598 |
| BACI7 | Ig kappa chain V-I region WEA, *Klebsiella* bacteria | | Goni, F. and Frangione, B., "Amino acid sequence of the Fv region of a human monoclonal IgM (protein WEA) with antibody activity against 3,4-pyruvylated galactose in *Klebsiella* polysaccharides K30 and K33", Proc. Natl. Acad. Sci. U.S.A. 80 (15), 4837-4841 (1983), P01763 | 7599 |
| BACI8 | Light chain variable region, *Enterococcus faecium, Enterococcus faecalis, Clostridium difficile* | | US20080038266 SEQ ID NO: 16 | 7600 |
| BACI9 | Light chain variable region, *Neisseria meningitidis* | Naid60 | US20060073139 SEQ ID NO: 6 | 7601 |
| BACI10 | Light chain, Septic shock, meningococcal septic shock, | Edobacomab, E5, XMMEN-0E5 | | 7602 |
| BACI11 | scFv antibody, Anti-*Burkholderia mallei* | | Zou, N., et al. "Human Single-Chain Fv Antibodies against *Burkholderia mallei* and *Burkholderia pseudomallei*", unpublished, NCBI Accession # ABI97022.1 | 7603 |
| BACI12 | scFv antibody, Anti-*Burkholderia mallei* | | Zou, N., et al. "Human Single-Chain Fv Antibodies against *Burkholderia mallei* and *Burkholderia pseudomallei*", unpublished, NCBI Accession # ABI97023.1 | 7604 |
| BACI13 | scFv antibody, Anti-*Burkholderia mallei* | | Zou, N., et al. "Human Single-Chain Fv Antibodies against *Burkholderia mallei* and *Burkholderia pseudomallei*", unpublished, NCBI Accession # ABI97021.1 | 7605 |

TABLE 39-continued

Antibodies against Bacteria

| Antibody No. | Description | Antibody Name | Reference Information | SEQ ID NO |
|---|---|---|---|---|
| BACI14 | scFv antibody, Anti-Burkholderia mallei | | Zou, N., et al. "Human Single-Chain Fv Antibodies against Burkholderia mallei and Burkholderia pseudomallei", unpublished, NCBI Accession # ABI97018.1 | 7606 |
| BACI15 | scFv antibody, Anti-Burkholderia mallei | | Zou, N., et al. "Human Single-Chain Fv Antibodies against Burkholderia mallei and Burkholderia pseudomallei", unpublished, NCBI Accession # ABI97024.1 | 7607 |
| BACI16 | scFv antibody, Anti-Burkholderia mallei | | Zou, N., et al. "Human Single-Chain Fv Antibodies against Burkholderia mallei and Burkholderia pseudomallei", unpublished, NCBI Accession # ACZ65033.1 | 7608 |
| BACI17 | scFv antibody, Anti-Burkholderia mallei | | Zou, N., et al. "Human Single-Chain Fv Antibodies against Burkholderia mallei and Burkholderia pseudomallei", unpublished, NCBI Accession # ACZ65032.1 | 7609 |
| BACI18 | scFv antibody, Anti-Burkholderia mallei | | Zou, N., et al. "Human Single-Chain Fv Antibodies against Burkholderia mallei and Burkholderia pseudomallei", unpublished, NCBI Accession # ACZ65031.1 | 7610 |
| BACI19 | scFv antibody, Anti-Burkholderia mallei | | Zou, N., et al. "Human Single-Chain Fv Antibodies against Burkholderia mallei and Burkholderia pseudomallei", unpublished, NCBI Accession # ACZ65030.1 | 7611 |
| BACI20 | scFv antibody, Anti-Burkholderia mallei | | Zou, N., et al. "Human Single-Chain. Fv Antibodies against Burkholderia mallei and Burkholderia pseudomallei", unpublished, NCBI Accession # ACZ65029.1 | 7612 |
| BACI21 | scFv antibody, Anti-Burkholderia mallei | | Zou, N., et al. "Human Single-Chain Fv Antibodies against Burkholderia mallei and Burkholderia pseudomallei", unpublished, NCBI Accession # ACZ65028.1 | 7613 |
| BAC122 | scFv antibody, Anti-Burkholderia mallei | | Zou, N,, et al. "Human Single-Chain Fv Antibodies against Burkholderia mallei and Burkholderia pseudomallei", unpublished, NCBI Accession # AB197020.1 | 7614 |
| BACI23 | scFv antibody, Anti-Burkholderia mallei | | Zou, N., et al. "Human Single-Chain Fv Antibodies against Burkholderia mallei and Burkholderia pseudomallei", unpublished, NCBI Accession # ABI97019.1 | 7615 |
| BACI24 | Single chain variable, Borrelia, | CB515 | LaRocca, T. J., et al. "Bactericidal action of a complement-independent relapsing fever Borrelia resides in its variable region", J. Immunol. 180 (9), 6222-6228 (2008), NCBI Accession # ABV22509 | 7616 |

In one embodiment, the payload region of the AAV particle comprises one or more nucleic acid sequences, fragment or variants encoding Doxorubicin, fragments or variants thereof for treating a disease and/or disorder or preventing a disease and/or disorder. As a non-limiting example, the disease and/or disorder is bacterial infection.

In one embodiment, the payload region of the AAV particle comprises one or more nucleic acid sequences encoding one or more of the payload antibody polypeptides listed in Table 40 against *Toxoplasma gondii*.

TABLE 40

Antibodies against *Toxoplasma gondii*

| Antibody No. | Description | Antibody Name | Reference Information | SEQ ID NO |
|---|---|---|---|---|
| TOXO1 | 4f11e12 | Fab Heavy Chain Variable Region, Surface antigen 1 (SAG1) | Graille, M. et al., J. Mol. Biol. 354 (2), 447-458 (2005), NCBI Accession # 1YNT_D (218aa) | 7617 |
| TOXO2 | 4f11e12 | Fab Light Chain Variable Region, Surface antigen 1 (SAG1) | Graille, M. et al., J. Mol, Biol. 354 (2), 447-458 (2005), NCBI Accession # 1YNT_C (213aa) | 7618 |

In one embodiment, the payload region of the AAV particle comprises one or more nucleic acid sequences encoding one or more of the payload antibody polypeptides listed in Table 41 against *Candida* Yeast

TABLE 41

Antibodies against *Candida* Yeast

| Antibody No. | Description | Antibody Name | SEQ ID NO |
|---|---|---|---|
| CAND1 | Efungumab | *Candida* | 7619 |

In one embodiment, the payload region of the AAV particle comprises one or more nucleic acid sequences encoding one or more of the payload antibody polypeptides listed in Table 42.

TABLE 42

HIV Antibodies

| Antibody No. | Description | Antibody Name | Reference Information | SEQ ID NO |
|---|---|---|---|---|
| HIV1 | 4e10 Antibody Germline Precursor 7 Heavy Chain Fv | 4e10antibody | NCBI Accession # 4OB5_H (127aa) | 7620 |
| HIV2 | 4e10 Antibody Germline Precursor 7 Light Chain Fv | 4e10antibody | NCBI Accession # 4OB5_L (114aa) | 7621 |
| HIV3 | Antigen Binding Fragment Of Heavy Chain | Ch103 | Liao et al., Co-evolution of a broadly neutralizing HIV-1 antibody and founder virus; Nature 496 (7446), 469-476 (2013), NCBI Accession # 4JAM_H (226aa) | 7622 |
| HIV4 | Antigen Binding Fragment Of Light Chain | Ch103 | Liao et al., Co-evolution of a broadly neutralizing HIV-1 antibody and founder virus; Nature 496 (7446), 469-476 (2013), NCBI Accession # 4JAM_L (209aa) | 7623 |
| HIV5 | Fab Fragment, Heavy Chain | N12-i15 | NCBI Accession # 3QEH_G (232aa) | 7624 |
| HIV6 | Fab Fragment, Light Chain | N12-i15 | NCBI Accession # 3QEH_H (218aa) | 7625 |
| HIV7 | Fab Heavy Chain | 35o22 | Huang et al., Broad and potent HIV-1 neutralization by a human antibody that binds the gp41-gp120 interface; Nature 515 (7525), 138-142 (2014), NCBI Accession # 4TOY_H (243 aa) | 7626 |
| HIV8 | Fab Heavy Chain | 8anc195 | Scharf, L., et al., Cell Rep 7 (3), 785-795 (2014), NCBI Accession # 4P9H_H (244aa) | 7627 |
| HIV9 | Fab Heavy Chain | B13 | Chen L. et al., Science 326 (5956), 1123-1127 (2009), NCBI Accession # 3IDY_B (231aa) | 7628 |
| HIV10 | Fab Heavy Chain | Ch58 | Liao et al., vaccine Induction of Antibodies against a Structurally Heterogeneous Site of Immune Pressure within HIV-1 Envelope Protein Variable region 1 and 2; Immunity 38 | 7629 |

TABLE 42-continued

HIV Antibodies

| Antibody No. | Description | Antibody Name | Reference Information | SEQ ID NO |
|---|---|---|---|---|
| HIV11 | Fab Heavy Chain | Ch59 | (1), 176-186 (2013), NCBI Accession # 4HQQ_H (231aa) Liao et al., vaccine Induction of Antibodies against a Structurally Heterogeneous Site of Immune Pressure within HIV-1 Envelope Protein Variable region 1 and 2; Immunity 38 (1), 176-186 (2013), NCBI Accession # 4HPY_H (225aa) | 7630 |
| HIV12 | Fab Heavy Chain | E51 | Huang C et al., Proc. Natl, Acad. Sci. U.S.A. 101 (9), 2706-2711 (2004), NCBI Accession # 1RZF_H (235aa) | 7631 |
| HIV13 | Fab Heavy Chain | N26-i1 Fab | NCBI Accession # 4FZE_H(232aa) | 7632 |
| HIV14 | Fab Heavy Chain | Pgt145 | McLellan, J. S. et al., Structure of HIV-1 gp120 V1 V2 domain with broadly neutralizing antibody PG9; Nature 480 (7377), 336-343 (2011), NCBI Accession # 3U1S_H (267aa) | 7633 |
| HIV15 | Fab Heavy Chain Of Human Anti-hiv-1 Env Antibody A32 | A32 Fab | NCBI Accession # 3TNM_A (231aa) | 7634 |
| HIV16 | Fab Heavy Chain Of Human Anti-hiv-1 Env Antibody C11 | C11 Fab | NCBI Accession # 4FZ8_H (237aa) | 7635 |
| HIV17 | Fab Light Chain | 35o22 | Huang et al., Broad and potent HIV-1 neutralization by a human antibody that binds the gp41-gp120 interface; Nature 515 (7525), 138-142 (2014), NCBI Accession # 4TOY_L (216aa) | 7636 |
| HIV18 | Fab Light Chain | 8anc195 | Scharf, L., et al., Cell Rep 7 (3), 785-795 (2014), NCBI Accession # 4P9H_L (215aa) | 7637 |
| HIV19 | Fab Light Chain | B13 | Chen L. et al., Science 326 (5956), 1123-1127 (2009), NCBI Accession # 3IDY_C (215aa) | 7638 |
| HIV20 | Fab Light Chain | Ch58 | Liao et al., vaccine Induction of Antibodies against a Structurally Heterogeneous Site of Immune Pressure within HIV-1 Envelope Protein Variable region 1 and 2; Immunity 38 (1), 176-186 (2013), NCBI Accession # 4HQQ_L (216aa) | 7639 |
| HIV21 | Fab Light Chain | Ch59 | Liao et al., vaccine Induction of Antibodies against a Structurally Heterogeneous Site of Immune Pressure within HIV-1 Envelope Protein Variable region 1 and 2; Immunity 38 (1), 176-186 (2013), NCBI Accession # 4HPY_L (215aa) | 7640 |
| HIV22 | Fab Light Chain | E51 | Huang C et al., Proc. Natl. Acad. Sci. U.S.A. 101 (9), 2706-2711 (2004), NCBI Accession # 1RZF_L (213aa) | 7641 |
| HIV23 | Fab Light Chain | Monoclonal Antibody Vrc03 | Bartesaghi, A. et al., Perfusion structure of trimeric HIV-1 envelope glycoprotein determined by cryo-electron microscopy; Nat. Struct. Mol. Biol. 20 (12), 1352-1357 (2013), NCBI Accession # 4CC8_L (209aa) | 7642 |
| HIV24 | Fab Light Chain | N26-i1 Fab | NCBI Accession# 4FZE_L (212aa) | 7643 |
| HIV25 | Fab Light Chain | Pgt145 | McLellan, J. S. et al., Structure of HIV-1 gp120 V1 V2 domain with broadly neutralizing antibody PG9; Nature 480 (7377), 336-343 (2011), NCBI Accession # 3U1S_L (239aa) | 7644 |
| HIV26 | Fab Light Chain Of Human Anti-hiv-1 Env Antibody A32 | A32 Fab | NCBI Accession # 3TNM_B (216aa) | 7645 |
| HIV27 | Fab Light Chain Of Human Anti-hiv-1 Env Antibody C11 | C11 Fab | NCBI Accession # 4FZ8_L (218aa) | 7646 |
| HIV28 | Fab Region Of The Heavy Chain | Fab 2558 | Gorny et al., PLoS ONE 6 (12), E27780 (2011), NCBI Accession # 3UJI_H (223aa) | 7647 |
| HIV29 | Fab Region Of The Heavy Chain | Fab 4025 | Gorny et al., PLoS ONE 6 (12), E27780 (2011), NCBI Accession # 3UJJ_H (230aa) | 7648 |
| HIV30 | Fab, Heavy Chain | 3bnc60 | Scheid, J. F., et al,. Science 333 (6049), 1633-1637 (2011), NCBI Accession # 3RPI_A (229aa) | 7649 |
| HIV31 | Fab, Heavy Chain | 48d | Huang C C et al., Proc. Natl. Acad. Sci. U.S.A. 101 (9), 2706-2711 (2004), NCBI Accession # 1R27_H (219aa) | 7650 |
| HIV32 | Fab, Heavy Chain | 4e10Fab | Bird et al., Nat. Struct. Mol. Biol. (2014), NCBI Accession # 4NGH_H (228aa) | 7651 |

TABLE 42-continued

| | | HIV Antibodies | | |
|---|---|---|---|---|
| Antibody No. | Description | Antibody Name | Reference Information | SEQ ID NO |
| HIV33 | Fab, Heavy Chain | Ch58-ua | Nicely et al. Ebiomedicine 2 (2015), NCBI Accession # 4RIS_H (230aa) | 7652 |
| HIV34 | Fab, Heavy chain | Mab 2909 | Spurrier, B., et al., Structure 19 (5), 691-699 (2011), NCBI Accession # 3Q6F_J (233aa) | 7653 |
| HIV35 | Fab, Heavy Chain | Monoclonal Antibody Vrc03 | Bartesaghi, A. et al., Perfusion structure of trimeric HIV-1 envelope glycoprotein determined by cryo-electron microscopy; Nat. Struct. Mol. Biol. 20 (12), 1352-1357 (2013), NCBI Accession # 4CC8_I (233aa) | 7654 |
| HIV36 | Fab, light chain | 3bnc60 | Scheid, J. F., et al., Science 333 (6049), 1633-1637 (2011), NCBI Accession # 3RPI_B (206aa) | 7655 |
| HIV37 | Fab, Light Chain | 48d | Huang C C et al., Proc. Natl. Acad. Sci. U.S.A. 101 (9), 2706-2711. (2004), NCBI Accession # 1RZ7_L (212aa) | 7656 |
| HIV38 | Fab, Light Chain | 4e10Fab | Bird et al., Nat. Struct. Mol. Biol. (2014), NCBI Accession # 4NGH_L (215aa) | 7657 |
| HIV39 | Fab, Light Chain | Ch58-ua | Nicely et al. Ebiomedicine 2 (2015), NCBI Accession # 4RIS_L (216aa) | 7658 |
| HIV40 | Fab, light Chain | Mab 2909 | Spurrier, B., et al., Structure 19 (5), 691-699 (2011), NCBI Accession # 3Q6F_K (213aa) | 7659 |
| HIV41 | Gamma heavy chain | 1443_C16 | U.S. Pat. No. 9,051,362 SEQ ID NO: 12 | 7660 |
| HIV42 | Gamma heavy chain | 1471_M23 | U.S. Pat. No. 9,051,362 SEQ ID NO: 139 | 7661 |
| HIV43 | Gamma heavy chain | 1489_I13 | U.S. Pat. No. 9,051,362 SEQ ID NO: 59 | 7662 |
| HIV44 | Gamma heavy chain | 1503_H05 | U.S. Pat. No. 9,051,362 SEQ ID NO: 53 | 7663 |
| HIV45 | Gamma heavy chain variable region | 1456_A12 | U.S. Pat. No. 9,051,362 SEQ ID NO: 48 | 7664 |
| HIV46 | Gamma heavy chain variable region | 1456_P20 | U.S. Pat. No. 9,051,362 SEQ ID NO: 33 | 7665 |
| HIV47 | Gamma heavy chain variable region | 1460_G14 | U.S. Pat. No. 9,051,362 SEQ ID NO: 35 | 7666 |
| HIV48 | Gamma heavy chain variable region | 1470_M23 | U.S. Pat. No. 9,051,362 SEQ ID NO: 140 | 7667 |
| HIV49 | Gamma heavy chain variable region | 1480_I08 | U.S. Pat. No. 9,051,362 SEQ ID NO: 31 | 7668 |
| HIV50 | Gamma heavy chain variable region | 1480_I08 | U.S. Pat. No. 9,051,362 SEQ ID NO: 65 | 7669 |
| HIV51 | Gamma heavy chain variable region | 1489_I13 | U.S. Pat. No. 9,051,362 SEQ ID NO: 60 | 7670 |
| HIV52 | Gamma heavy chain variable region | 1495_C14 | U.S. Pat. No. 9,051,362 SEQ ID NO: 37 | 7671 |
| HIV53 | Gamma heavy chain variable region | 1503_H05 | U.S. Pat. No. 9,051,362 SEQ ID NO: 54 | 7672 |
| HIV54 | Gamma heavy chain variable region | 1496_C09 | U.S. Pat. No. 9,051,362 SEQ ID NO: 39 | 7673 |
| HIV55 | Gamma heavy chain | 1456_A12 | U.S. Pat. No. 9,051,362 SEQ ID NO: 47 | 7674 |
| HIV56 | Gamma heavy chain | 1460_G14 | U.S. Pat. No. 9,051,362 SEQ ID NO: 20 | 7675 |
| HIV57 | Gamma heavy chain | 1495_C14 | U.S. Pat. No. 9,051,362 SEQ ID NO: 24 | 7676 |
| HIV58 | Gamma heavy chain | 1496_C09 | U.S. Pat. No. 9,051,362 SEQ ID NO: 28 | 7677 |
| HIV59 | Gamma heavy | 1456_P20 | U.S. Pat. No. 9,051,362 SEQ ID NO: 16 | 7678 |
| HIV60 | Gp41-specific antibody, heavy chain | | US20140348785 SEQ ID NO: 11 | 7679 |
| HIV61 | Gp41-specific antibody, heavy chain consensus | | US20140348785 SEQ ID NO: 146 | 7680 |
| HIV62 | Gp41-specific antibody, heavy chain consensus variable region | | US20140348785 SEQ ID NO: 187 | 7681 |
| HIV63 | Gp41-specific antibody, heavy chain consensus variable region | | US20140348785 SEQ ID NO: 188 | 7682 |
| HIV64 | Gp41-specific antibody, heavy chain variable region | | US20140348785 SEQ ID NO: 153 | 7683 |
| HIV65 | Gp41-specific antibody, heavy chain variable region | | US20140348785 SEQ ID NO: 154 | 7684 |
| HIV66 | Gp41-specific antibody, heavy chain variable region | | US20140348785 SEQ ID NO: 155 | 7685 |

TABLE 42-continued

HIV Antibodies

| Antibody No. | Description | Antibody Name | Reference Information | SEQ ID NO |
|---|---|---|---|---|
| HIV67 | Gp41-specific antibody, heavy chain variable region | | US20140348785 SEQ ID NO: 156 | 7686 |
| HIV68 | Gp41-specific antibody, heavy chain variable region | | US20140348785 SEQ ID NO: 157 | 7687 |
| HIV69 | Gp41-specific antibody, heavy chain variable region | | US20140348785 SEQ ID NO: 158 | 7688 |
| HIV70 | Gp41-specific antibody, heavy chain variable region | | US20140348785 SEQ ID NO: 159 | 7689 |
| HIV71 | Gp41-specific antibody, heavy chain variable region | | US20140348785 SEQ ID NO: 160 | 7690 |
| HIV72 | Gp41-specific antibody, heavy chain variable region | | US20140348785 SEQ ID NO: 161 | 7691 |
| HIV73 | Gp41-specific antibody, heavy chain variable region | | US20140348785 SEQ ID NO: 162 | 7692 |
| HIV74 | Gp41 -specific antibody, heavy chain variable region | | US20140348785 SEQ ID NO: 163 | 7693 |
| HIV75 | Gp41-specific antibody, heavy chain variable region | | US20140348785 SEQ ID NO: 189 | 7694 |
| HIV76 | Gp41-specific antibody, heavy chain variable region | | US20140348785 SEQ ID NO: 190 | 7695 |
| HIV77 | Gp41-specific antibody, heavy chain variable region | | US20140348785 SEQ ID NO: 191 | 7696 |
| HIV78 | Gp41-specific antibody, heavy chain variable region | | US20140348785 SEQ ID NO: 192 | 7697 |
| HIV79 | Gp41-specific antibody, heavy chain variable region | | US20140348785 SEQ ID NO: 200 | 7698 |
| HIV80 | Gp41-specific antibody, heavy chain variable region | | US20140348785 SEQ ID NO: 201 | 7699 |
| HIV81 | Gp41-specific antibody, heavy chain variable region | | US20140348785 SEQ ID NO: 202 | 7700 |
| HIV82 | Gp41-specific antibody, heavy chain variable region | | US20140348785 SEQ ID NO: 203 | 7701 |
| HIV83 | Gp41-specific antibody, heavy chain variable region | | US20140348785 SEQ ID NO: 204 | 7702 |
| HIV84 | Gp41-specific antibody, heavy chain variable region | | US20140348785 SEQ ID NO: 205 | 7703 |
| HIV85 | Gp41-specific antibody, heavy chain variable region | | US20140348785 SEQ ID NO: 206 | 7704 |
| HIV86 | Gp41-specific antibody, heavy chain variable region | | US20140348785 SEQ ID NO: 207 | 7705 |
| HIV87 | Gp41-specific antibody, heavy chain variable region | | US20140348785 SEQ ID NO: 208 | 7706 |
| HIV88 | Gp41-specific antibody, heavy chain variable region | | US20140348785 SEQ ID NO: 209 | 7707 |
| HIV89 | Gp41-specific antibody, light chain variable region | | US20140348785 SEQ ID NO: 12 | 7708 |
| HIV90 | Gp41-specific antibody, light chain variable region | | US20140348785 SEQ ID NO: 164 | 7709 |

TABLE 42-continued

HIV Antibodies

| Antibody No. | Description | Antibody Name | Reference Information | SEQ ID NO |
|---|---|---|---|---|
| HIV91 | Gp41-specific antibody, light chain variable region | | US20140348785 SEQ ID NO: 165 | 7710 |
| HIV92 | Gp41-specific antibody, light chain variable region | | US20140348785 SEQ ID NO: 166 | 7711 |
| HIV93 | Gp41-specific antibody, light chain variable region | | US20140348785 SEQ ID NO: 167 | 7712 |
| HIV94 | Gp41-specific antibody, light chain variable region | | US20140348785 SEQ ID NO: 168 | 7713 |
| HIV95 | Gp41-specific antibody, light chain variable region | | US20140348785 SEQ ID NO: 169 | 7714 |
| HIV96 | Gp41-specific antibody, light chain variable region | | US20140348785 SEQ ID NO: 170 | 7715 |
| HIV97 | Gp41-specific antibody, light chain variable region | | US20140348785 SEQ ID NO: 171 | 7716 |
| HIV98 | Gp41-specific antibody, light chain variable region | | US20140348785 SEQ ID NO: 172 | 7717 |
| HIV99 | Gp41-specific antibody, light chain variable region | | US20140348785 SEQ ID NO: 173 | 7718 |
| HIV100 | Gp41-specific antibody, light chain variable region | | US20140348785 SEQ ID NO: 174 | 7719 |
| HIV101 | Gp41-specific antibody, light chain variable region | | US20140348785 SEQ ID NO: 175 | 7720 |
| HIV102 | Gp41-specific antibody, light chain variable region | | US20140348785 SEQ ID NO: 176 | 7721 |
| HIV103 | Gp41-specific antibody, light chain variable region | | US20140348785 SEQ ID NO: 177 | 7722 |
| HIV104 | Gp41-specific antibody, light chain variable region | | US20140348785 SEQ ID NO: 178 | 7723 |
| HIV105 | Gp41-specific antibody, light chain variable region | | US20140348785 SEQ ID NO: 179 | 7724 |
| HIV106 | Gp41-specific antibody, light chain variable region | | US20140348785 SEQ ID NO: 180 | 7725 |
| HIV107 | Gp41-specific antibody, light chain variable region | | US20140348785 SEQ ID NO: 181 | 7726 |
| HIV108 | Gp41-specific antibody, light chain variable region | | US20140348785 SEQ ID NO: 182 | 7727 |
| HIV109 | Gp41-specific antibody, light chain variable region | | US20140348785 SEQ ID NO: 183 | 7728 |
| HIV110 | Gp41-specific antibody, light chain variable region | | US20140348785 SEQ ID NO: 184 | 7729 |
| HIV111 | Gp41-specific antibody, light chain variable region | | US20140348785 SEQ ID NO: 185 | 7730 |
| HIV112 | Gp41-specific antibody, light chain variable region | | US20140348785 SEQ ID NO: 186 | 7731 |
| HIV113 | Gp41-specific antibody, light chain variable region | | US20140348785 SEQ ID NO: 197 | 7732 |
| HIV114 | Gp41-specific antibody, light chain variable region | | US20140348785 SEQ ID NO: 198 | 7733 |

TABLE 42-continued

HIV Antibodies

| Antibody No. | Description | Antibody Name | Reference Information | SEQ ID NO |
|---|---|---|---|---|
| HIV115 | Gp41-specific antibody, light chain variable region | | US20140348785 SEQ ID NO: 199 | 7734 |
| HIV116 | Heavy chain | Vrc06b | Wu, X., et al., Maturation and Diversity of the VRC01-Antibody Lineage over 15 Years of Chronic HIV-1 Infection; Cell 161 (3), 470-485 (2015), NCBI Accession # 4XNZ_E (234aa) | 7735 |
| HIV117 | Heavy Chain | 2424 | Kumar, R., et al., Functional and Structural Characterization of Human V3-Specific Monoclonal Antibody 2424 with Neutralizing Activity against HIV-1 JRFL; J. Virol. 89 (17), 9090-9102 (2015), NCBI Accession # 4XML_H(223aa) | 7736 |
| HIV118 | Heavy chain | 5827 | US20140205607 Table S13 | 7737 |
| HIV119 | Heavy chain | 7863 | US20140205607 Table S13 | 7738 |
| HIV120 | Heavy Chain | 8062 | Gustchina, E., PLoS ONE 8 (11), E78187 (2013), NCBI Accession # 4KHX_H(245aa) | 7739 |
| HIV121 | Heavy chain | 18761 | US20140205607 Table S13 | 7740 |
| HIV122 | Heavy chain | 19891 | US20140205607 Table S13 | 7741 |
| HIV123 | Heavy chain | 22425 | US20140205607 Table S13 | 7742 |
| HIV124 | Heavy chain | 28241 | US20140205607 Table S13 | 7743 |
| HIV125 | Heavy chain | 61272 | US20140205607 Table S13 | 7744 |
| HIV126 | Heavy chain | 61822 | US20140205607 Table S13 | 7745 |
| HIV127 | Heavy chain | 65030 | US20140205607 Table S13 | 7746 |
| HIV128 | Heavy chain | 70085 | US20140205607 Table S13 | 7747 |
| HIV129 | Heavy chain | 70542 | US20140205607 Table S13 | 7748 |
| HIV130 | Heavy chain | 80585 | US20140205607 Table S13 | 7749 |
| HIV131 | Heavy chain | 87722 | US20140205607 Table S13 | 7750 |
| HIV132 | Heavy chain | 96362 | US20140205607 Table S13 | 7751 |
| HIV133 | Heavy chain | 103787 | US20140205607 Table S13 | 7752 |
| HIV134 | Heavy chain | 146940 | US20140205607 Table S13 | 7753 |
| HIV135 | Heavy chain | 153849 | US20140205607 Table S13 | 7754 |
| HIV136 | Heavy chain | 1.00E+09 | US20140348785 SEQ ID NO: 1 | 7755 |
| HIV137 | Heavy chain | 104625_2 | US20140205607 Table S14 | 7756 |
| HIV138 | Heavy chain | 105239_4 | US20140205607 Table S14 | 7757 |
| HIV139 | Heavy chain | 10731_1 | US20140205607 Table S14 | 7758 |
| HIV140 | Heavy Chain | 10e8 (monoclonal) | Huang J et al., Nature 491 (7424), 406-412 (2012), NCBI Accession # 4G6F_B (236aa) | 7759 |
| HIV141 | Heavy chain | 120119_4 | US20140205607 Table S14 | 7760 |
| HIV142 | Heavy chain | 121325_4 | US20140205607 Table S14 | 7761 |
| HIV143 | Heavy chain | 12467_3 | US20140205607 Table S14 | 7762 |
| HIV144 | Heavy chain | 124918_2 | US20140205607 Table S14 | 7763 |
| HIV145 | Heavy chain | 127586_4 | US20140205607 Table S14 | 7764 |
| HIV146 | Heavy chain | 12A10HC | US20140328862 SEQ ID NO: 147 | 7765 |
| HIV147 | Heavy chain | 12A12HC | US20140328862 SEQ ID NO: 148 | 7766 |
| HIV148 | Heavy chain | 12A13HC | US20140328862 SEQ ID NO: 149 | 7767 |
| HIV149 | Heavy chain | 12A16HC | US20140328862 SEQ ID NO: 150 | 7768 |
| HIV150 | Heavy chain | 12A17HC | US20140328862 SEQ ID NO: 151 | 7769 |
| HIV151 | Heavy chain | 12A1HC | US20140328862 SEQ ID NO: 152 | 7770 |
| HIV152 | Heavy chain | 12A20HC | US20140328862 SEQ ID NO: 153 | 7771 |
| HIV153 | Heavy Chain | 12a21 | NCBI Accession # 4JPW_H (225aa) | 7772 |
| HIV154 | Heavy chain | 12A21HC | US20140328862 SEQ ID NO: 154 | 7773 |
| HIV155 | Heavy chain | I2A22HC | US20140328862 SEQ ID NO: 155 | 7774 |
| HIV156 | Heavy chain | 12A23HC | US20140328862 SEQ ID NO: 156 | 7775 |
| HIV157 | Heavy chain | 12A27HC | US20140328862 SEQ ID NO: 157 | 7776 |
| HIV158 | Heavy chain | 12A2HC | US20140328862 SEQ ID NO: 158 | 7777 |
| HIV159 | Heavy chain | 12A30HC | US20140328862 SEQ ID NO: 159 | 7778 |
| HIV160 | Heavy chain | 12A37HC | US20140328862 SEQ ID NO: 160 | 7779 |
| HIV161 | Heavy chain | 12A46HC | US20140328862 SEQ ID NO: 161 | 7780 |
| HIV162 | Heavy chain | 12A4HC | US20140328862 SEQ ID NO: 162 | 7781 |
| HIV163 | Heavy chain | 12A55HC | US20140328862 SEQ ID NO: 163 | 7782 |
| HIV164 | Heavy chain | 12A56HC | US20140328862 SEQ ID NO: 164 | 7783 |
| HIV165 | Heavy chain | 12A6HC | US20140328862 SEQ ID NO: 165 | 7784 |
| HIV166 | Heavy chain | 12A7HC | US20140328862 SEQ ID NO: 166 | 7785 |
| HIV167 | Heavy chain | 12A9HC | US20140328862 SEQ ID NO: 167 | 7786 |
| HIV168 | Heavy chain | 132797_4 | US20140205607 Table S14 | 7787 |
| HIV169 | Heavy chain | 135083_3 | US20140205607 Table S14 | 7788 |
| HIV170 | Heavy chain | 13826_2 | US20140205607 Table S14 | 7789 |
| HIV171 | Heavy chain | 143251_3 | US20140205607 Table S14 | 7790 |
| HIV172 | Heavy chain | 149590_4 | US20140205607 Table S14 | 7791 |
| HIV173 | Heavy chain | 149768_4 | US20140205607 Table S14 | 7792 |
| HIV174 | Heavy chain | 151901_4 | US20140205607 Table S14 | 7793 |
| HIV175 | Heavy chain | 156858_3 | US20140205607 Table S14 | 7794 |
| HIV176 | Heavy chain | 164202_3 | US20140205607 Table S14 | 7795 |

TABLE 42-continued

HIV Antibodies

| Antibody No. | Description | Antibody Name | Reference Information | SEQ ID NO |
|---|---|---|---|---|
| HIV177 | Heavy chain | 164922_3 | US20140205607 Table S14 | 7796 |
| HIV178 | Heavy chain | 165478_2 | US20140205607 Table S14 | 7797 |
| HIV179 | Heavy chain | 166726_3 | US20140205607 Table S14 | 7798 |
| HIV180 | Heavy chain | 167612_4 | US20140205607 Table S14 | 7799 |
| HIV181 | Heavy chain | 168509_2 | US20140205607 Table S14 | 7800 |
| HIV182 | Heavy chain | 169094_4 | US20140205607 Table S14 | 7801 |
| HIV183 | Heavy chain | 17720_4 | US20140205607 Table S14 | 7802 |
| HIV184 | Heavy chain | 178037_3 | US20140205607 Table S14 | 7803 |
| HIV185 | Heavy chain | 179400_4 | US20140205607 Table S14 | 7804 |
| HIV186 | Heavy chain | 179500_4 | US20140205607 Table S14 | 7805 |
| HIV187 | Heavy chain | 179888_3 | US20140205607 Table S14 | 7806 |
| HIV188 | Heavy Chain | 17b | Kwong, P. D., et al., structure of an HIV gp120 envelope glycoprotein in complex with the CD4 receptor and a neutralizing human antibody; Nature 393 (6686), 648-659 (1998), NCBI Accession# 1G9M_H (229aa) | 7807 |
| HIV189 | Heavy chain | 18278_1 | US20140205607 Table S14 | 7808 |
| HIV190 | Heavy chain | 184939_4 | US20140205607 Table S14 | 7809 |
| HIV191 | Heavy chain | 185961_4 | US20140205607 Table S14 | 7810 |
| HIV192 | Heavy chain | 186066_4 | US20140205607 Table S14 | 7811 |
| HIV193 | Heavy chain | 186275_2 | US20140205607 Table S14 | 7812 |
| HIV194 | Heavy chain | 186640_2 | US20140205607 Table S14 | 7813 |
| HIV195 | Heavy chain | 190244_4 | US20140205607 Table S14 | 7814 |
| HIV196 | Heavy chain | 193526_4 | US20140205607 Table S14 | 7815 |
| HIV197 | Heavy chain | 193896_4 | US20140205607 Table S14 | 7816 |
| HIV198 | Heavy chain | 195462_4 | US20140205607 Table S14 | 7817 |
| HIV199 | Heavy chain | 196147_4 | US20140205607 Table S14 | 7818 |
| HIV200 | Heavy chain | 196283_4 | US20140205607 Table S14 | 7819 |
| HIV201 | Heavy Chain | 1b2530 | Zhou T el al., Structural Repertoire of HIV-1-Neutralizing Antibodies Targeting the CD4 Supersite in 14 Donors; Cell 161 (6), 1280-1292 (2015), NCBI Accession # 4YFL_H (227aa) | 7820 |
| HIV202 | Heavy chain | 1F7 | U.S. Pat. No. 6,057,421A FIG. 8 | 7821 |
| HIV203 | Heavy chain | 1NC9 | WO2012154312 SEQ ID NO: 2471 | 7822 |
| HIV204 | Heavy Chain | 2.2C | Acharya, P., et al., Structural Definition of an Antibody-Dependent Cellular Cytotoxicity Response Implicated in Reduced Risk for HIV-1 Infection; J. Virol. 88 (21), 12895-12906 (2014), NCBI Accession # 4R4N_H (220aa) | 7823 |
| HIV205 | Heavy chain | 24972_4 | US20140205607 Table S14 | 7824 |
| HIV206 | Heavy chain | 28936_1 | US20140205607 Table S14 | 7825 |
| HIV207 | Heavy chain | 2F5 | U.S. Pat. No. 8,637,036B2 SEQ ID NO: 5 | 7826 |
| HIV208 | Heavy chain | 2F5 F100BW | U.S. Pat. No. 8,637,036B2 SEQ ID NO: 7 | 7827 |
| HIV209 | Heavy chain | 2F5 L100AW | U.S. Pat. No. 8,637,036B2 SEQ ID NO: 6 | 7828 |
| HIV210 | Heavy chain | 2F5 L100AW-V100DW | U.S. Pat. No. 8,637,036B2 SEQ ID NO: 9 | 7829 |
| HIV211 | Heavy chain | 2F5 V100DW | U.S. Pat. No. 8,637,036B2 SEQ ID NO: 8 | 7830 |
| HIV212 | Heavy chain | 30263_2 | US20140205607 Table S14 | 7831 |
| HIV213 | Heavy chain | 3040HC | WO2015117008 SEQ ID NO: 14 | 7832 |
| HIV214 | Heavy chain | 3044HC | WO20S5117008 SEQ ID NO: 17 | 7833 |
| HIV215 | Heavy chain | 31458_3 | US20140205607 Table S14 | 7834 |
| HIV216 | Heavy chain | 3430HC | WO2015117008 SEQ ID NO: 15 | 7835 |
| HIV217 | Heavy chain | 3484HC | WO2015117008 SEQ ID NO: 16 | 7836 |
| HIV218 | Heavy chain | 3630HC | WO2015117008 SEQ ID NO: 18 | 7837 |
| HIV219 | Heavy chain | 3A124HC | US20140328862 SEQ ID NO: 261 | 7838 |
| HIV220 | Heavy chain | 3A125HC | US20140328862 SEQ ID NO: 262 | 7839 |
| HIV221 | Heavy chain | 3A140HC | US20140328862 SEQ ID NO: 263 | 7840 |
| HIV222 | Heavy chain | 3A144HC | US20140328862 SEQ ID NO: 264 | 7841 |
| HIV223 | Heavy chain | 3A160HC | US20140328862 SEQ ID NO: 265 | 7842 |
| HIV224 | Heavy chain | 3A18HC | US20140328862 SEQ ID NO: 266 | 7843 |
| HIV225 | Heavy chain | 3A204HC | US20140328862 SEQ ID NO: 267 | 7844 |
| HIV226 | Heavy chain | 3A228HC | US20140328862 SEQ ID NO: 268 | 7845 |
| HIV227 | Heavy chain | 3A233HC | US20140328862 SEQ ID NO: 269 | 7846 |
| HIV228 | Heavy chain | 3A244HC | US20140328862 SEQ ID NO: 270 | 7847 |
| HIV229 | Heavy chain | 3A255HC | US20140328862 SEQ ID NO: 271 | 7848 |
| HIV230 | Heavy chain | 3A296HC | US20140328862 SEQ ID NO: 272 | 7849 |
| HIV231 | Heavy chain | 3A334HC | US20140328862 SEQ ID NO: 273 | 7850 |
| HIV232 | Heavy chain | 3A366HC | US20140328862 SEQ ID NO: 274 | 7851 |
| HIV233 | Heavy chain | 3A381HC | US20140328862 SEQ ID NO: 275 | 7852 |
| HIV234 | Heavy chain | 3A384HC | US20140328862 SEQ ID NO: 276 | 7853 |
| HIV235 | Heavy chain | 3A419HC | US20140328862 SEQ ID NO: 277 | 7854 |

TABLE 42-continued

HIV Antibodies

| Antibody No. | Description | Antibody Name | Reference Information | SEQ ID NO |
|---|---|---|---|---|
| HIV236 | Heavy chain | 3a426hc | US20140328862 SEQ ID NO: 343 | 7855 |
| HIV237 | Heavy chain | 3A461HC | US20140328862 SEQ ID NO: 278 | 7856 |
| HIV238 | Heavy chain | 3A474HC | US20140328862 SEQ ID NO: 279 | 7857 |
| HIV239 | Heavy chain | 3a515hc | US20140328862 SEQ ID NO: 344 | 7858 |
| HIV240 | Heavy chain | 3A518HC | US20140328862 SEQ ID NO: 280 | 7859 |
| HIV241 | Heavy chain | 3A539HC | US20140328862 SEQ ID NO: 281 | 7860 |
| HIV242 | Heavy chain | 3A576HC | US20140328862 SEQ ID NO: 282 | 7861 |
| HIV243 | Heavy chain | 3A613HC | US20140328862 SEQ ID NO: 283 | 7862 |
| HIV244 | Heavy chain | 3A64HC | US20140328862 SEQ ID NO: 284 | 7863 |
| HIV245 | Heavy chain | 3A650HC | US20140328862 SEQ ID NO: 285 | 7864 |
| HIV246 | Heavy chain | 3A67HC | US20140328862 SEQ ID NO: 286 | 7865 |
| HIV247 | Heavy chain | 3A779HC | US20140328862 SEQ ID NO: 287 | 7866 |
| HIV248 | Heavy chain | 3A816HC | US20140328862 SEQ ID NO: 288 | 7867 |
| HIV249 | Heavy chain | 3A869HC | US20140328862 SEQ ID NO: 289 | 7868 |
| HIV250 | Heavy chain | 3A93HC | US20140328862 SEQ ID NO: 290 | 7869 |
| HIV251 | Heavy chain | 3A966HC | US20140328862 SEQ ID NO: 291 | 7870 |
| HIV252 | Heavy chain | 3A978HC | US20140328862 SEQ ID NO: 292 | 7871 |
| HIV253 | Heavy chain | 3ANC32HC | US20140328862 SEQ ID NO: 346 | 7872 |
| HIV254 | Heavy chain | 3ANC3HC | US20140328862 SEQ ID NO: 293 | 7873 |
| HIV255 | Heavy chain | 3ANC3HC | US20140328862 SEQ ID NO: 347 | 7874 |
| HIV256 | Heavy chain | 3ANC41HC | US20140328862 SEQ ID NO: 348 | 7875 |
| HIV257 | Heavy chain | 3ANC42HC | US20140328862 SEQ ID NO: 294 | 7876 |
| HIV258 | Heavy chain | 3ANC42HC | US20140328862 SEQ ID NO: 349 | 7877 |
| HIV259 | Heavy chain | 3ANC66HC | US20140328862 SEQ ID NO: 295 | 7878 |
| HIV260 | Heavy chain | 3ANC66HC | US20140328862 SEQ ID NO: 350 | 7879 |
| HIV261 | Heavy chain | 3ANC70HC | US20140328862 SEQ ID NO: 351 | 7880 |
| HIV262 | Heavy chain | 3ANC75HC | US20140328862 SEQ ID NO: 352 | 7881 |
| HIV263 | Heavy chain | 3ANC79HC | US20140328862 SEQ ID NO: 296 | 7882 |
| HIV264 | Heavy chain | 3ANC79HC | US20140328862 SEQ ID NO: 353 | 7883 |
| HIV265 | Heavy chain | 3ANC87HC | US20140328862 SEQ ID NO: 354 | 7884 |
| HIV266 | Heavy chain | 3ANC8HC | US20140328862 SEQ ID NO: 355 | 7885 |
| HIV267 | Heavy chain | 3ANC96HC | US20140328862 SEQ ID NO: 356 | 7886 |
| HIV268 | Heavy chain | 3B106HC | US20140328862 SEQ ID NO: 357 | 7887 |
| HIV269 | Heavy chain | 3B10HC | US20140328862 SEQ ID NO: 297 | 7888 |
| HIV270 | Heavy chain | 3B120HC | US20140328862 SEQ ID NO: 298 | 7889 |
| HIV271 | Heavy chain | 3B126HC | US20140328862 SEQ ID NO: 299 | 7890 |
| HIV272 | Heavy chain | 3B129HC | US20140328862 SEQ ID NO: 300 | 7891 |
| HIV273 | Heavy chain | 3B142HC | US20140328862 SEQ ID NO: 301 | 7892 |
| HIV274 | Heavy chain | 3B154HC | US20140328862 SEQ ID NO: 302 | 7893 |
| HIV275 | Heavy chain | 3B165HC | US20140328862 SEQ ID NO: 303 | 7894 |
| HIV276 | Heavy chain | 3B16HC | US20140328862 SEQ ID NO: 358 | 7895 |
| HIV277 | Heavy chain | 3B171HC | US20140328862 SEQ ID NO: 304 | 7896 |
| HIV278 | Heavy chain | 3B17HC | US20140328862 SEQ ID NO: 305 | 7897 |
| HIV279 | Heavy chain | 3B180HC | US20140328862 SEQ ID NO: 359 | 7898 |
| HIV280 | Heavy chain | 3B183HC | US20140328862 SEQ ID NO: 360 | 7899 |
| HIV281 | Heavy chain | 3B186HC | US20140328862 SEQ ID NO: 306 | 7900 |
| HIV282 | Heavy chain | 3B191HC | US20140328862 SEQ ID NO: 361 | 7901 |
| HIV283 | Heavy chain | 3B193HC | US20140328862 SEQ ID NO: 307 | 7902 |
| HIV284 | Heavy chain | 3B21HC | US20140328862 SEQ ID NO: 362 | 7903 |
| HIV285 | Heavy chain | 3B22HC | US20140328862 SEQ ID NO: 308 | 7904 |
| HIV286 | Heavy chain | 3B27HC | US20140328862 SEQ ID NO: 309 | 7905 |
| HIV287 | Heavy chain | 3B29HC | US20140328862 SEQ ID NO: 310 | 7906 |
| HIV288 | Heavy chain | 3B2HC | US20140328862 SEQ ID NO: 311 | 7907 |
| HIV289 | Heavy chain | 3B31HC | US20140328862 SEQ ID NO: 312 | 7908 |
| HIV290 | Heavy chain | 3B33HC | US20140328862 SEQ ID NO: 313 | 7909 |
| HIV291 | Heavy chain | 3B40HC | US20140328862 SEQ ID NO: 314 | 7910 |
| HIV292 | Heavy chain | 3B41HC | US20140328862 SEQ ID NO: 315 | 7911 |
| HIV293 | Heavy chain | 3B44HC | US20140328862 SEQ ID NO: 316 | 7912 |
| HIV294 | Heavy chain | 3B45HC | US20140328862 SEQ ID NO: 317 | 7913 |
| HIV295 | Heavy chain | 3b46HC | US20140328862 SEQ ID NO: 345 | 7914 |
| HIV296 | Heavy chain | 3B48HC | US20140328862 SEQ ID NO: 318 | 7915 |
| HIV297 | Heavy chain | 3B50HC | US20140328862 SEQ ID NO: 319 | 7916 |
| HIV298 | Heavy chain | 3B51HC | US20140328862 SEQ ID NO: 320 | 7917 |
| HIV299 | Heavy chain | 3B56HC | US20140328862 SEQ ID NO: 321 | 7918 |
| HIV300 | Heavy chain | 3B57HC | US20140328862 SEQ ID NO: 322 | 7919 |
| HIV301 | Heavy chain | 3B5HC | US20140328862 SEQ ID NO: 323 | 7920 |
| HIV302 | Heavy chain | 3B61HC | US20140328862 SEQ ID NO: 324 | 7921 |
| HIV303 | Heavy chain | 3B6HC | US20140328862 SEQ ID NO: 325 | 7922 |
| HIV304 | Heavy chain | 3B77HC | US20140328862 SEQ ID NO: 326 | 7923 |
| HIV305 | Heavy chain | 3B79HC | US20140328862 SEQ ID NO: 327 | 7924 |
| HIV306 | Heavy chain | 3B84HC | US20140328862 SEQ ID NO: 328 | 7925 |
| HIV307 | Heavy chain | 3B86HC | US20140328862 SEQ ID NO: 329 | 7926 |
| HIV308 | Heavy chain | 3B8HC | US20140328862 SEQ ID NO: 330 | 7927 |
| HIV309 | Heavy chain | 3B93HC | US20140328862 SEQ ID NO: 331 | 7928 |

TABLE 42-continued

HIV Antibodies

| Antibody No. | Description | Antibody Name | Reference Information | SEQ ID NO |
|---|---|---|---|---|
| HIV310 | Heavy chain | 3BBM60 | US20140328862 SEQ ID NO: 363 | 7929 |
| HIV311 | Heavy chain | 3BBM60 | US20140328862 SEQ ID NO: 364 | 7930 |
| HIV312 | Heavy chain | 3BBM60 | US20140328862 SEQ ID NO: 365 | 7931 |
| HIV313 | Heavy chain | 3BBM60 | US20140328862 SEQ ID NO: 366 | 7932 |
| HIV314 | Heavy chain | 3BBM60 | US20140328862 SEQ ID NO: 367 | 7933 |
| HIV315 | Heavy chain | 3BBM60 | US20140328862 SEQ ID NO: 368 | 7934 |
| HIV316 | Heavy chain | 3BBM60 | US20140328862 SEQ ID NO: 369 | 7935 |
| HIV317 | Heavy chain | 3BBM60 | US20140328862 SEQ ID NO: 370 | 7936 |
| HIV318 | Heavy chain | 3BBM60 | US20140328862 SEQ ID NO: 371 | 7937 |
| HIV319 | Heavy chain | 3BBM60 | US20140328862 SEQ ID NO: 372 | 7938 |
| HIV320 | Heavy chain | 3BBM60 | US20140328862 SEQ ID NO: 373 | 7939 |
| HIV321 | Heavy chain | 3BBM60 | US20140328862 SEQ ID NO: 374 | 7940 |
| HIV322 | Heavy chain | 3BBM60 | US20140328862 SEQ ID NO: 375 | 7941 |
| HIV323 | Heavy chain | 3BBM60 | US20140328862 SEQ ID NO: 376 | 7942 |
| HIV324 | Heavy chain | 3BBM60 | US20140328862 SEQ ID NO: 377 | 7943 |
| HIV325 | Heavy chain | 3BNC101HC | US20140328862 SEQ ID NO: 332 | 7944 |
| HIV326 | Heavy chain | 3BNC101HC | US20140328862 SEQ ID NO: 378 | 7945 |
| HIV327 | Heavy chain | 3BNC102HC | US20140328862 SEQ ID NO: 379 | 7946 |
| HIV328 | Heavy chain | 3BNC104HC | US20140328862 SEQ ID NO: 380 | 7947 |
| HIV329 | Heavy chain | 3BNC105HC | US20140328862 SEQ ID NO: 381 | 7948 |
| HIV330 | Heavy chain | 3BNC106HC | US20140328862 SEQ ID NO: 382 | 7949 |
| HIV331 | Heavy chain | 3BNC107HC | US20140328862 SEQ ID NO: 383 | 7950 |
| HIV332 | Heavy chain | 3BNC108HC | US20140328862 SEQ ID NO: 384 | 7951 |
| HIV333 | Heavy chain | 3BNC10HC | US20140328862 SEQ ID NO: 385 | 7952 |
| HIV334 | Heavy chain | 3BNC114HC | US20140328862 SEQ ID NO: 386 | 7953 |
| HIV335 | Heavy Chain | 3bnc117 | Zhou T et al., Immunity 39 (2), 245-258 (2013), NCBI Accession # 4LSV_H (226aa) | 7954 |
| HIV336 | Heavy chain | 3BNC117HC | US20140328862 SEQ ID NO: 387 | 7955 |
| HIV337 | Heavy chain | 3BNC124HC | US20140328862 SEQ ID NO: 333 | 7956 |
| HIV338 | Heavy chain | 3BNC126HC | US20140328862 SEQ ID NO: 388 | 7957 |
| HIV339 | Heavy chain | 3BNC127HC | US20140328862 SEQ ID NO: 389 | 7958 |
| HIV340 | Heavy chain | 3BNC130HC | US20140328862 SEQ ID NO: 334 | 7959 |
| HIV341 | Heavy chain | 3BNC134HC | US20140328862 SEQ ID NO: 390 | 7960 |
| HIV342 | Heavy chain | 3BNC140HC | US20140328862 SEQ ID NO: 391 | 7961 |
| HIV343 | Heavy chain | 3BNC141HC | US20140328862 SEQ ID NO: 392 | 7962 |
| HIV344 | Heavy chain | 3BNC142HC | US20140328862 SEQ ID NO: 393 | 7963 |
| HIV345 | Heavy chain | 3BNC148HC | US20140328862 SEQ ID NO: 394 | 7964 |
| HIV346 | Heavy chain | 3BNC149HC | US20140328862 SEQ ID NO: 335 | 7965 |
| HIV347 | Heavy chain | 3BNC149HC | US20140328862 SEQ ID NO: 395 | 7966 |
| HIV348 | Heavy chain | 3BNC151HC | US20140328862 SEQ ID NO: 396 | 7967 |
| HIV349 | Heavy chain | 3BNC153HC | US20140328862 SEQ ID NO: 397 | 7968 |
| HIV350 | Heavy chain | 3BNC156HC | US20140328862 SEQ ID NO: 398 | 7969 |
| HIV351 | Heavy chain | 3BNC158HC | US20140328862 SEQ ID NO: 399 | 7970 |
| HIV352 | Heavy chain | 3BNC159HC | US20140328862 SEQ ID NO: 400 | 7971 |
| HIV353 | Heavy chain | 3BNC15HC | US20140328862 SEQ ID NO: 401 | 7972 |
| HIV354 | Heavy chain | 3BNC173HC | US20140328862 SEQ ID NO: 402 | 7973 |
| HIV355 | Heavy chain | 3BNC175HC | US20140328862 SEQ ID NO: 403 | 7974 |
| HIV356 | Heavy chain | 3BNC176HC | US20140328862 SEQ ID NO: 404 | 7975 |
| HIV357 | Heavy chain | 3BNC177HC | US20140328862 SEQ ID NO: 336 | 7976 |
| HIV358 | Heavy chain | 3BNC17HC | US20140328862 SEQ ID NO: 337 | 7977 |
| HIV359 | Heavy chain | 3BNC181HC | US20140328862 SEQ ID NO: 405 | 7978 |
| HIV360 | Heavy chain | 3BNC186HC | US20140328862 SEQ ID NO: 406 | 7979 |
| HIV361 | Heavy chain | 3BNC18HC | US20140328862 SEQ ID NO: 407 | 7980 |
| HIV362 | Heavy chain | 3BNC193HC | US20140328862 SEQ ID NO: 408 | 7981 |
| HIV363 | Heavy chain | 3BNC196HC | US20140328862 SEQ ID NO: 409 | 7982 |
| HIV364 | Heavy chain | 3BNC20HC | US20140328862 SEQ ID NO: 410 | 7983 |
| HIV365 | Heavy chain | 3BNC29HC | US20140328862 SEQ ID NO: 411 | 7984 |
| HIV366 | Heavy chain | 3BNC31HC | US20140328862 SEQ ID NO: 412 | 7985 |
| HIV367 | Heavy chain | 3BNC33HC | US20140328862 SEQ ID NO: 413 | 7986 |
| HIV368 | Heavy chain | 3BNC42HC | US20140328862 SEQ ID NO: 414 | 7987 |
| HIV369 | Heavy chain | 3BNC44HC | US20140328862 SEQ ID NO: 415 | 7988 |
| HIV370 | Heavy chain | 3BNC45HC | US20140328862 SEQ ID NO: 416 | 7989 |
| HIV371 | Heavy chain | 3BNC48HC | US20140328862 SEQ ID NO: 338 | 7990 |
| HIV372 | Heavy chain | 3BNC53HC | US20140328862 SEQ ID NO: 417 | 7991 |
| HIV373 | Heavy chain | 3BNC54HC | US20140328862 SEQ ID NO: 418 | 7992 |
| HIV374 | Heavy chain | 3BNC55HC | US20140328862 SEQ ID NO: 419 | 7993 |
| HIV375 | Heavy chain | 3BNC58HC | US20140328862 SEQ ID NO: 339 | 7994 |
| HIV376 | Heavy chain | 3BNC59HC | US20140328862 SEQ ID NO: 420 | 7995 |
| HIV377 | Heavy chain | 3BNC60HC | US20140328862 SEQ ID NO: 421 | 7996 |
| HIV378 | Heavy chain | 3BNC62HC | US20140328862 SEQ ID NO: 422 | 7997 |
| HIV379 | Heavy chain | 3BNC64HC | US20140328862 SEQ ID NO: 423 | 7998 |
| HIV380 | Heavy chain | 3BNC65HC | US20140328862 SEQ ID NO: 424 | 7999 |
| HIV381 | Heavy chain | 3BNC66HC | US20140328862 SEQ ID NO: 425 | 8000 |
| HIV382 | Heavy chain | 3BNC6HC | US20140328862 SEQ ID NO: 426 | 8001 |

TABLE 42-continued

HIV Antibodies

| Antibody No. | Description | Antibody Name | Reference Information | SEQ ID NO |
|---|---|---|---|---|
| HIV383 | Heavy chain | 3BNC72HC | US20140328862 SEQ ID NO: 427 | 8002 |
| HIV384 | Heavy chain | 3BNC75HC | US20140328862 SEQ ID NO: 428 | 8003 |
| HIV385 | Heavy chain | 3BNC78HC | US20140328862 SEQ ID NO: 340 | 8004 |
| HIV386 | Heavy chain | 3BNC79HC | US20140328862 SEQ ID NO: 429 | 8005 |
| HIV387 | Heavy chain | 3BNC81HC | US20140328862 SEQ ID NO: 430 | 8006 |
| HIV388 | Heavy chain | 3BNC82HC | US20140328862 SEQ ID NO: 341 | 8007 |
| HIV389 | Heavy chain | 3BNC84HC | US20140328862 SEQ ID NO: 431 | 8008 |
| HIV390 | Heavy chain | 3BNC86HC | US20140328862 SEQ ID NO: 432 | 8009 |
| HIV391 | Heavy chain | 3BNC87HC | US20140328862 SEQ ID NO: 433 | 8010 |
| HIV392 | Heavy chain | 3BNC89HC | US20140328862 SEQ ID NO: 434 | 8011 |
| HIV393 | Heavy chain | 3BNC8HC | US20140328862 SEQ ID NO: 342 | 8012 |
| HIV394 | Heavy chain | 3BNC91HC | US20140328862 SEQ ID NO: 435 | 8013 |
| HIV395 | Heavy chain | 3BNC92HC | US20140328862 SEQ ID NO: 436 | 8014 |
| HIV396 | Heavy chain | 3BNC94HC | US20140328862 SEQ ID NO: 437 | 8015 |
| HIV397 | Heavy chain | 3BNC95HC | US20140328862 SEQ ID NO: 438 | 8016 |
| HIV398 | Heavy Chain | 412d | Huang et al., Science 317 (5846), 1930-1934 (2007), NCBI Accession # 2QAD_H (231aa) | 8017 |
| HIV399 | Heavy chain | 43243_3 | US20140205607 Table S14 | 8018 |
| HIV400 | Heavy chain | 43359_2 | US20140205607 Table S14 | 8019 |
| HIV401 | Heavy chain | 43555_1 | US20140205607 Table S14 | 8020 |
| HIV402 | Heavy chain | 43567_2 | US20140205607 Table S14 | 8021 |
| HIV403 | Heavy Chain | 44-vrc13.01 | Zhou T et al., Structural Repertoire of HIV-1-Neutralizing Antibodies Targeting the CD4 Supersite in 14 Donors; Cell 161 (6), 1280-1292 (2015), NCBI Accession # 4YDJ_A(238aa) | 8022 |
| HIV404 | Heavy chain | 45-46m2 | Diskin, R., et al., Restricting HIV-1 pathways for escape using rationally designed anti-HIV-1 antibodies; J. Exp. Med. 210 (6), 1235-1249 (2013), NCBI Accession # 4JKP_H (229aa) | 8023 |
| HIV405 | Heavy chain | 46260_1 | US20140205607 Table S14 | 8024 |
| HIV406 | Heavy chain | 47890_1 | US20140205607 Table S14 | 8025 |
| HIV407 | Heavy Chain | 4e10 Fv | Finton, K. A., et al., PLoS Pathol. 9 (9), E1003639 (2013), NCBI Accession # 4LLV_A (129aa) | 8026 |
| HIV408 | Heavy chain | 53821_1 | US20140205607 Table S14 | 8027 |
| HIV409 | Heavy chain | 57729_2 | US20140205607 Table S14 | 8028 |
| HIV410 | Heavy chain | 61048_1 | US20140205607 Table S14 | 8029 |
| HIV411 | Heavy chain | 69713_1 | US20140205607 Table S14 | 8030 |
| HIV412 | Heavy chain | 70679_1 | US20140205607 Table S14 | 8031 |
| HIV413 | Heavy chain | 71632_2 | US20140205607 Table S14 | 8032 |
| HIV414 | Heavy chain | 74400_3 | US20140205607 Table S14 | 8033 |
| HIV415 | Heavy chain | 74511_1 | US20140205607 Table S14 | 8034 |
| HIV416 | Heavy chain | 76927_2 | US20140205607 Table S14 | 8035 |
| HIV417 | Heavy Chain | 7b2 | Santra, S., et al., PLoS Pathol. 11 (8), E1005042 (2015), NCBI Accession # 4YDV_H (252aa) | 8036 |
| HIV418 | Heavy chain | 7H6 | US20140348785 SEQ ID NO: 3 | 8037 |
| HIV419 | Heavy chain | 7N16 | US20140348785 SEQ ID NO: 5 | 8038 |
| HIV420 | Heavy chain | 8460_4 | US20140205607 Table S14 | 8039 |
| HIV421 | Heavy chain | 86277_2 | US20140205607 Table S14 | 8040 |
| HIV422 | Heavy chain | 86343_1 | US20140205607 Table S14 | 8041 |
| HIV423 | Heavy chain | 86984_2 | US20140205607 Table S14 | 8042 |
| HIV424 | Heavy chain | 89680_4 | US20140205607 Table S14 | 8043 |
| HIV425 | Heavy chain | 8A253HC | US20140328862 SEQ ID NO: 5 | 8044 |
| HIV426 | Heavy chain | 8A275HC | US20140328862 SEQ ID NO: 6 | 8045 |
| HIV427 | Heavy chain | 8ABM11 | US20140328862 SEQ ID NO: 7 | 8046 |
| HIV428 | Heavy chain | 8ABM12 | US20140328862 SEQ ID NO: 8 | 8047 |
| HIV429 | Heavy chain | 8ABM13 | US20140328862 SEQ ID NO: 9 | 8048 |
| HIV430 | Heavy chain | 8ABM14 | US20140328862 SEQ ID NO: 10 | 8049 |
| HIV431 | Heavy chain | 8ABM20 | US20140328862 SEQ ID NO: 11 | 8050 |
| HIV432 | Heavy chain | 8ABM24 | US20140328862 SEQ ID NO: 12 | 8051 |
| HIV433 | Heavy chain | 8ABM26 | US20140328862 SEQ ID NO: 13 | 8052 |
| HIV434 | Heavy chain | 8ABM27 | US20140328862 SEQ ID NO: 14 | 8053 |
| HIV435 | Heavy chain | 8ANC103HC | US20140328862 SEQ ID NO: 36 | 8054 |
| HIV436 | Heavy chain | 8ANC105HC | US20140328862 SEQ ID NO: 15 | 8055 |
| HIV437 | Heavy chain | 8ANC106HC | US20140328862 SEQ ID NO: 37 | 8056 |
| HIV438 | Heavy chain | 8ANC107HC | US20140328862 SEQ ID NO: 38 | 8057 |
| HIV439 | Heavy chain | 8ANC108HC | US20140328862 SEQ ID NO: 39 | 8058 |
| HIV440 | Heavy chain | 8ANC109HC | US20140328862 SEQ ID NO: 40 | 8059 |
| HIV441 | Heavy chain | 8ANC10HC | US20140328862 SEQ ID NO: 41 | 8060 |
| HIV442 | Heavy chain | 8ANC111HC | US20140328862 SEQ ID NO: 42 | 8061 |
| HIV443 | Heavy chain | 8ANC112HC | US20140328862 SEQ ID NO: 43 | 8062 |
| HIV444 | Heavy chain | 8ANC113HC | US20140328862 SEQ ID NO: 44 | 8063 |

TABLE 42-continued

HIV Antibodies

| Antibody No. | Description | Antibody Name | Reference Information | SEQ ID NO |
|---|---|---|---|---|
| HIV445 | Heavy chain | 8ANC114HC | US20140328862 SEQ ID NO: 45 | 8064 |
| HIV446 | Heavy chain | 8ANC115HC | US20140328862 SEQ ID NO: 46 | 8065 |
| HIV447 | Heavy chain | 8ANC116HC | US20140328862 SEQ ID NO: 16 | 8066 |
| HIV448 | Heavy chain | 8ANC117HC | US20140328862 SEQ ID NO: 47 | 8067 |
| HIV449 | Heavy chain | 8ANC11HC | US20140328862 SEQ ID NO: 48 | 8068 |
| HIV450 | Heavy chain | 8ANC121HC | US20140328862 SEQ ID NO: 49 | 8069 |
| HIV451 | Heavy chain | 8ANC126HC | US20140328862 SEQ ID NO: 50 | 8070 |
| HIV452 | Heavy chain | 8ANC127HC | US20140328862 SEQ ID NO: 17 | 8071 |
| HIV453 | Heavy chain | 8ANC130HC | US20140328862 SEQ ID NO: 51 | 8072 |
| HIV454 | Heavy Chain | 8anc131 | Zhou T et al., Structural Repertoire of HIV-1-Neutralizing Antibodies Targeting the CD4 Supersite in 14 Donors; Cell 161 (6), 1280-1292 (2015), NCBI Accession # 4RWY_H (227aa) | 8073 |
| HIV455 | Heavy chain | 8ANC131HC | US20140328862 SEQ ID NO: 18 | 8074 |
| HIV456 | Heavy chain | 8ANC132HC | US20140328862 SEQ ID NO: 52 | 8075 |
| HIV457 | Heavy chain | 8ANC133HC | US20140328862 SEQ ID NO: 53 | 8076 |
| HIV458 | Heavy Chain | 8anc134 | Zhou T et al., Structural Repertoire of HIV-1-Neutralizing Antibodies Targeting the CD4 Supersite in 14 Donors; Cell 161 (6), 1280-1292 (2015), NCBI Accession # 4RX4_H (229aa) | 8077 |
| HIV459 | Heavy chain | 8ANC134HC | US20140328862 SEQ ID NO: 19 | 8078 |
| HIV460 | Heavy chain | 8ANC136HC | US20140328862 SEQ ID NO: 54 | 8079 |
| HIV461 | Heavy chain | 8ANC137HC | US20140328862 SEQ ID NO: 55 | 8080 |
| HIV462 | Heavy chain | 8ANC139HC | US20140328862 SEQ ID NO: 56 | 8081 |
| HIV463 | Heavy chain | 8ANC13HC | US20140328862 SEQ ID NO: 20 | 8082 |
| HIV464 | Heavy chain | 8ANC140HC | US20140328862 SEQ ID NO: 57 | 8083 |
| HIV465 | Heavy chain | 8ANC142HC | US20140328862 SEQ ID NO: 58 | 8084 |
| HIV466 | Heavy chain | 8ANC143HC | US20140328862 SEQ ID NO: 59 | 8085 |
| HIV467 | Heavy chain | 8ANC144HC | US20140328862 SEQ ID NO: 60 | 8086 |
| HIV468 | Heavy chain | 8ANC145HC | US20140328862 SEQ ID NO: 61 | 8087 |
| HIV469 | Heavy chain | 8ANC146HC | US20140328862 SEQ ID NO: 62 | 8088 |
| HIV470 | Heavy chain | 8ANC147HC | US20140328862 SEQ ID NO: 63 | 8089 |
| HIV471 | Heavy chain | 8ANC148HC | US20140328862 SEQ ID NO: 64 | 8090 |
| HIV472 | Heavy chain | 8ANC149HC | US20140328862 SEQ ID NO: 65 | 8091 |
| HIV473 | Heavy chain | 8ANC14HC | US20140328862 SEQ ID NO: 66 | 8092 |
| HIV474 | Heavy chain | 8ANC150HC | US20140328862 SEQ ID NO: 67 | 8093 |
| HIV475 | Heavy chain | 8ANC151HC | US20140328862 SEQ ID NO: 68 | 8094 |
| HIV476 | Heavy chain | 8ANC153HC | US20140328862 SEQ ID NO: 69 | 8095 |
| HIV477 | Heavy chain | 8ANC154HC | US20140328862 SEQ ID NO: 70 | 8096 |
| HIV478 | Heavy chain | 8ANC155HC | US20140328862 SEQ ID NO: 71 | 8097 |
| HIV479 | Heavy chain | 8ANC156HC | US20140328862 SEQ ID NO: 72 | 8098 |
| HIV480 | Heavy chain | 8ANC157HC | US20140328862 SEQ ID NO: 73 | 8099 |
| HIV481 | Heavy chain | 8ANC158HC | US20140328862 SEQ ID NO: 74 | 8100 |
| HIV482 | Heavy chain | 8ANC160HC | US20140328862 SEQ ID NO: 75 | 8101 |
| HIV483 | Heavy chain | 8ANC161HC | US20140328862 SEQ ID NO: 76 | 8102 |
| HIV484 | Heavy chain | 8ANC162HC | US20140328862 SEQ ID NO: 77 | 8103 |
| HIV485 | Heavy chain | 8ANC163HC | US20140328862 SEQ ID NO: 78 | 8104 |
| HIV486 | Heavy chain | 8ANC164HC | US20140328862 SEQ ID NO: 79 | 8105 |
| HIV487 | Heavy chain | 8ANC165HC | US20140328862 SEQ ID NO: 80 | 8106 |
| HIV488 | Heavy chain | 8ANC166HC | US20140328862 SEQ ID NO: 81 | 8107 |
| HIV489 | Heavy chain | 8ANC168HC | US20140328862 SEQ ID NO: 82 | 8108 |
| HIV490 | Heavy chain | 8ANC169HC | US20140328862 SEQ ID NO: 83 | 8109 |
| HIV491 | Heavy chain | 8ANC16HC | US20140328862 SEQ ID NO: 84 | 8110 |
| HIV492 | Heavy chain | 8ANC171HC | US20140328862 SEQ ID NO: 21 | 8111 |
| HIV493 | Heavy chain | 8ANC173HC | US20140328862 SEQ ID NO: 85 | 8112 |
| HIV494 | Heavy chain | 8ANC174HC | US20140328862 SEQ ID NO: 86 | 8113 |
| HIV495 | Heavy chain | 8ANC175HC | US20140328862 SEQ ID NO: 87 | 8114 |
| HIV496 | Heavy chain | 8ANC176HC | US20140328862 SEQ ID NO: 88 | 8115 |
| HIV497 | Heavy chain | 8ANC177HC | US20140328862 SEQ ID NO: 89 | 8116 |
| HIV498 | Heavy chain | 8ANC178HC | US20140328862 SEQ ID NO: 90 | 8117 |
| HIV499 | Heavy chain | 8ANC179HC | US20140328862 SEQ ID NO: 91 | 8118 |
| HIV500 | Heavy chain | 8ANC17HC | US20140328862 SEQ ID NO: 92 | 8119 |
| HIV501 | Heavy chain | 8ANC18 | US20140328862 SEQ ID NO: 22 | 8120 |
| HIV502 | Heavy chain | 8ANC180HC | US20140328862 SEQ ID NO: 93 | 8121 |
| HIV503 | Heavy chain | 8ANC181HC | US20140328862 SEQ ID NO: 94 | 8122 |
| HIV504 | Heavy chain | 8ANC182HC | US20140328862 SEQ ID NO: 23 | 8123 |
| HIV505 | Heavy chain | 8ANC184HC | US20140328862 SEQ ID NO: 95 | 8124 |
| HIV506 | Heavy chain | 8ANC185HC | US20140328862 SEQ ID NO: 96 | 8125 |
| HIV507 | Heavy chain | 8ANC186HC | US20140328862 SEQ ID NO: 97 | 8126 |
| HIV508 | Heavy chain | 8ANC187HC | US20140328862 SEQ ID NO: 98 | 8127 |
| HIV509 | Heavy chain | 8ANC188HC | US20140328862 SEQ ID NO: 99 | 8128 |
| HIV510 | Heavy chain | 8ANC191HC | US20140328862 SEQ ID NO: 100 | 8129 |

TABLE 42-continued

HIV Antibodies

| Antibody No. | Description | Antibody Name | Reference Information | SEQ ID NO |
|---|---|---|---|---|
| HIV511 | Heavy chain | 8ANC192HC | US20140328862 SEQ ID NO: 24 | 8130 |
| HIV512 | Heavy chain | 8ANC193HC | US20140328862 SEQ ID NO: 101 | 8131 |
| HIV513 | Heavy chain | 8ANC194HC | US20140328862 SEQ ID NO: 102 | 8132 |
| HIV514 | Heavy chain | 8ANC195HC | US20140328862 SEQ ID NO: 103 | 8133 |
| HIV515 | Heavy chain | 8ANC196HC | US20140328862 SEQ ID NO: 104 | 8134 |
| HIV516 | Heavy chain | 8ANC20HC | US20140328862 SEQ ID NO: 105 | 8135 |
| HIV517 | Heavy chain | 8ANC21HC | US20140328862 SEQ ID NO: 106 | 8136 |
| HIV518 | Heavy chain | 8ANC22HC | US20140328862 SEQ ID NO: 25 | 8137 |
| HIV519 | Heavy chain | 8ANC24HC | US20140328862 SEQ ID NO: 107 | 8138 |
| HIV520 | Heavy chain | 8ANC25HC | US20140328862 SEQ ID NO: 108 | 8139 |
| HIV521 | Heavy chain | 8ANC26HC | US20140328862 SEQ ID NO: 26 | 8140 |
| HIV522 | Heavy chain | 8ANC27HC | US20140328862 SEQ ID NO: 109 | 8141 |
| HIV523 | Heavy chain | 8ANC2HC | US20140328862 SEQ ID NO: 27 | 8142 |
| HIV524 | Heavy chain | 8ANC30HC | US20140328862 SEQ ID NO: 28 | 8143 |
| HIV525 | Heavy chain | 8ANC31HC | US20140328862 SEQ ID NO: 110 | 8144 |
| HIV526 | Heavy chain | 8ANC33HC | US20140328862 SEQ ID NO: 111 | 8145 |
| HIV527 | Heavy chain | 8ANC34HC | US20140328862 SEQ ID NO: 112 | 8146 |
| HIV528 | Heavy chain | 8ANC36HC | US20140328862 SEQ ID NO: 113 | 8147 |
| HIV529 | Heavy chain | 8ANC37HC | US20140328862 SEQ ID NO: 29 | 8148 |
| HIV530 | Heavy chain | 8ANC38HC | US20140328862 SEQ ID NO: 114 | 8149 |
| HIV531 | Heavy chain | 8ANC39HC | US20140328862 SEQ ID NO: 115 | 8150 |
| HIV532 | Heavy chain | 8ANC3HC | US20140328862 SEQ ID NO: 116 | 8151 |
| HIV533 | Heavy chain | 8ANC40HC | US20140328862 SEQ ID NO: 30 | 8152 |
| HIV534 | Heavy chain | 8ANC41HC | US20140328862 SEQ ID NO: 31 | 8153 |
| HIV535 | Heavy chain | 8ANC43HC | US20140328862 SEQ ID NO: 117 | 8154 |
| HIV536 | Heavy chain | 8ANC45HC | US20140328862 SEQ ID NO: 32 | 8155 |
| HIV537 | Heavy chain | 8ANC46HC | US20140328862 SEQ ID NO: 118 | 8156 |
| HIV538 | Heavy chain | 8ANC48HC | US20140328862 SEQ ID NO: 119 | 8157 |
| HIV539 | Heavy chain | 8ANC49HC | US20140328862 SEQ ID NO: 120 | 8158 |
| HIV540 | Heavy chain | 8ANC50HC | US20140328862 SEQ ID NO: 33 | 8159 |
| HIV541 | Heavy chain | 8ANC51HC | US20140328862 SEQ ID NO: 121 | 8160 |
| HIV542 | Heavy chain | 8ANC53HC | US20140328862 SEQ ID NO: 34 | 8161 |
| HIV543 | Heavy chain | 8ANC57HC | US20140328862 SEQ ID NO: 122 | 8162 |
| HIV544 | Heavy chain | 8ANC58HC | US20140328862 SEQ ID NO: 123 | 8163 |
| HIV545 | Heavy chain | 8ANC5HC | US20140328862 SEQ ID NO: 124 | 8164 |
| HIV546 | Heavy chain | 8ANC60HC | US20140328862 SEQ ID NO: 125 | 8165 |
| HIV547 | Heavy chain | 8ANC63HC | US20140328862 SEQ ID NO: 126 | 8166 |
| HIV548 | Heavy chain | 8ANC65HC | US20140328862 SEQ ID NO: 127 | 8167 |
| HIV549 | Heavy chain | 8ANC67HC | US20140328862 SEQ ID NO: 128 | 8168 |
| HIV550 | Heavy chain | 8ANC69HC | US20140328862 SEQ ID NO: 129 | 8169 |
| HIV551 | Heavy chain | 8ANC6HC | US20140328862 SEQ ID NO: 130 | 8170 |
| HIV552 | Heavy chain | 8ANC70HC | US20140328862 SEQ ID NO: 131 | 8171 |
| HIV553 | Heavy chain | 8ANC71HC | US20140328862 SEQ ID NO: 132 | 8172 |
| HIV554 | Heavy chain | 8ANC72HC | US20140328862 SEQ ID NO: 133 | 8173 |
| HIV555 | Heavy chain | 8ANC74HC | US20140328862 SEQ ID NO: 134 | 8174 |
| HIV556 | Heavy chain | 8ANC75HC | US20140328862 SEQ ID NO: 135 | 8175 |
| HIV557 | Heavy chain | 8ANC76HC | US20140328862 SEQ ID NO: 136 | 8176 |
| HIV558 | Heavy chain | 8ANC78HC | US20140328862 SEQ ID NO: 137 | 8177 |
| HIV559 | Heavy chain | 8ANC79HC | US20140328862 SEQ ID NO: 138 | 8178 |
| HIV560 | Heavy chain | 8ANC7HC | US20140328862 SEQ ID NO: 139 | 8179 |
| HIV561 | Heavy chain | 8ANC80HC | US20140328862 SEQ ID NO: 140 | 8180 |
| HIV562 | Heavy chain | 8ANC82HC | US20140328862 SEQ ID NO: 141 | 8181 |
| HIV563 | Heavy chain | 8ANC83HC | US20140328862 SEQ ID NO: 142 | 8182 |
| HIV564 | Heavy chain | 8ANC88HC | US20140328862 SEQ ID NO: 35 | 8183 |
| HIV565 | Heavy chain | 8ANC91HC | US20140328862 SEQ ID NO: 143 | 8184 |
| HIV566 | Heavy chain | 8ANC92HC | US20140328862 SEQ ID NO: 144 | 8185 |
| HIV567 | Heavy chain | 8ANC93HC | US20140328862 SEQ ID NO: 145 | 8186 |
| HIV568 | Heavy chain | 8ANC9HC | US20140328862 SEQ ID NO: 146 | 8187 |
| HIV569 | Heavy chain | 94565_1 | US20140205607 Table S14 | 8188 |
| HIV570 | Heavy chain | 95589_2 | US20140205607 Table S14 | 8189 |
| HIV571 | Heavy chain | 96298_1 | US20140205607 Table S14 | 8190 |
| HIV572 | Heavy chain | 9815_2 | US20140205607 Table S14 | 8191 |
| HIV573 | Heavy chain | 99473_3 | US20140205607 Table S14 | 8192 |
| HIV574 | Heavy chain | 99989_1 | US20140205607 Table S14 | 8193 |
| HIV575 | Heavy chain | Antibody | US20140328862 SEQ ID NO: 439 | 8194 |
| HIV576 | Heavy chain | Anti-HcG | Fotinou C. et al "Structure of an Fab fragment against a C-terminal peptide of hCG at 2.0 A resolution" J. Biol. Chem. 273 (35), 22515-22518 (1998); NCBI Accession # 1SBS_H | 8195 |
| HIV577 | Heavy Chain | B12 | Zhou T et al., Structural definition of a conserved neutralization epitope on HIV-1 gp120; Nature 445 (7129), 732-737 (2007), NCBI Accession # 2NY7_H (230aa) | 8196 |

TABLE 42-continued

HIV Antibodies

| Antibody No. | Description | Antibody Name | Reference Information | SEQ ID NO |
|---|---|---|---|---|
| HIV578 | Heavy Chain | C38-vrc16.01 | Zhou T et al., Structural Repertoire of HIV-1-Neutralizing Antibodies Targeting the CD4 Supersite in 14 Donors; Cell 161 (6), 1280-1292 (2015), NCBI Accession # 4YDK_H (234aa) | 8197 |
| HIV579 | Heavy Chain | C38-vrc18.02 | Zhou T et al., Structural Repertoire of HIV-1-Neutralizing Antibodies Targeting the CD4 Supersite in 14 Donors; Cell 161 (6), 1280-1292 (2015), NCBI Accession # 4YDL_H (226aa) | 8198 |
| HIV580 | Heavy chain | CAP256-VRC26.01 | WO2015128846 SEQ ID NO: 13 | 8199 |
| HIV581 | Heavy chain | CAP256-VRC26.02 | WO2015128846 SEQ ID NO: 17 | 8200 |
| HIV582 | Heavy chain | CAP256-VRC26.03 | WO2015128846 SEQ ID NO: 21 | 8201 |
| HIV583 | Heavy chain | CAP256-VRC26.04 | WO2015128846 SEQ ID NO: 25 | 8202 |
| HIV584 | Heavy chain | CAP256-VRC26.05 | WO2015128846 SEQ ID NO: 29 | 8203 |
| HIV585 | Heavy chain | CAP256-VRC26.06 | WO2015128846 SEQ ID NO: 33 | 8204 |
| HIV586 | Heavy chain | CAP256-VRC26.07 | WO2015128846 SEQ ID NO: 37 | 8205 |
| HIV587 | Heavy chain | CAP256-VRC26.08 | WO2015128846 SEQ ID NO: 41 | 8206 |
| HIV588 | Heavy chain | CAP256-VRC26.09 | WO2015128846 SEQ ID NO: 45 | 8207 |
| HIV589 | Heavy chain | CAP256-VRC26.10 | WO2015128846 SEQ ID NO: 49 | 8208 |
| HIV590 | Heavy chain | CAP256-VRC26.11 | WO2015128846 SEQ ID NO: 53 | 8209 |
| HIV591 | Heavy chain | CAP256-VRC26.12 | WO2015128846 SEQ ID NO: 57 | 8210 |
| HIV592 | Heavy chain | CAP256-VRC26.25 | WO2015128846 SEQ ID NO: 170 | 8211 |
| HIV593 | Heavy chain | CAP256-VRC26.26 | WO2015128846 SEQ ID NO: 178 | 8212 |
| HIV594 | Heavy chain | CAP256-VRC26.27 | WO2015128846 SEQ ID NO: 186 | 8213 |
| HIV595 | Heavy chain | CAP256-VRC26-I1 | WO2015128846 SEQ ID NO: 5 | 8214 |
| HIV596 | Heavy chain | CAP256-VRC26-I2. | WO2015128846 SEQ ID NO: 9 | 8215 |
| HIV597 | Heavy chain | CAP256-VRC26-UCA. | WO2015128846 SEQ ID NO: 1 | 8216 |
| HIV598 | Heavy chain | construct #2816, #2859 | WO2015013390 SEQ ID NO: 3 | 8217 |
| HIV599 | Heavy chain | construct #2817 | WO2015013390 SEQ ID NO: 4 | 8218 |
| HIV600 | Heavy chain | construct #2858, #2860 | WO2015013390 SEQ ID NO: 8 | 8219 |
| HIV601 | Heavy Chain | Fab 2219 | Stanfield, R. L., et al., J. Virol. 80 (12), 6093-6105 (2006), NCBI Accession # 2B0S_H (226aa) | 8220 |
| HIV602 | Heavy Chain | Fab 2g12 | Doores. K. J., et al., J. Virol. 84 (20), 10690-10699 (2010), NCBI Accession # 3OAU_H (225aa) | 8221 |
| HIV603 | Heavy Chain | Fab 2g12 | Stanfield, R. L. et al., Crystal structure of the HIV neutralizing antibody 2G12 in complex with a bacterial oligosaccharide analog of mammalian oligomannose; Glycobiology 25 (4), 412-419 (2015), NCBI Accession # 4RBP_H (224aa) | 8222 |
| HIV604 | Heavy Chain | Fab F425-b4e8 | Bell et al., J. Mol. Biol. 375 (4), 969-978 (2008), NCBI Accession # 2QSC_H (222aa) | 8223 |
| HIV605 | Heavy chain | fusion protein of A32 and m9 | US20080038280 SEQ ID NO: 5 | 8224 |
| HIV606 | Heavy chain | g20 | WO2015117008 SEQ ID NO: 4 | 8225 |
| HIV607 | Heavy chain | g22 | WO2015117008 SEQ ID NO: 7 | 8226 |
| HIV608 | Heavy chain | g23 | WO2015117008 SEQ ID NO: 2 | 8227 |
| HIV609 | Heavy chain | g3 | WO2015117008 SEQ ID NO: 13 | 8228 |

TABLE 42-continued

HIV Antibodies

| Antibody No. | Description | Antibody Name | Reference Information | SEQ ID NO |
|---|---|---|---|---|
| HIV610 | Heavy chain | g4 | WO2015117008 SEQ ID NO: 9 | 8229 |
| HIV611 | Heavy chain | g44 | WO2015117008 SEQ ID NO: 11 | 8230 |
| HIV612 | Heavy chain | g46 | WO2015117008 SEQ ID NO: 10 | 8231 |
| HIV613 | Heavy chain | G4D | US20130195881 SEQ ID NO: 9 | 8232 |
| HIV614 | Heavy chain | G4H | US20130195881 SEQ ID NO: 8 | 8233 |
| HIV615 | Heavy chain | g50 | WO2015117008 SEQ ID NO: 12 | 8234 |
| HIV616 | Heavy chain | g52 | WO2015117008 SEQ ID NO: 1 | 8235 |
| HIV617 | Heavy chain | g59 | WO2015117008 SEQ ID NO: 5 | 8236 |
| HIV618 | Heavy chain | g62 | WO2015117008 SEQ ID NO: 6 | 8237 |
| HIV619 | Heavy chain | g8 | WO2015117008 SEQ ID NO: 3 | 8238 |
| HIV620 | Heavy chain | gl5 | WO2015117008 SEQ ID NO: 8 | 8239 |
| HIV621 | Heavy chain | gVRC-H5(d74)/VRC-PG04LC | WO2013090644 SEQ ID NO: 45 | 8240 |
| HIV622 | Heavy chain | gVRCOH12(D74)/VRC-PG04LC | WO2013090644 SEQ ID NO: 46 | 8241 |
| HIV623 | Heavy Chain | I2 (unbound) From Ch103 Lineage | Fera, D. et al., Affinity maturation in an HIV broadly neutralizing B-cell lineage through reorientation of variable domains; Proc. Natl. Acad. Sci. U.S.A. 111 (28), 10275-10280 (2014), NCBI Accession # 4QHN_A (232aa) | 8242 |
| HIV624 | Heavy chain | IGHV3-15*05 | US20140348785 SEQ ID NO: 7 | 8243 |
| HIV625 | Heavy chain | LSSB2055HC | US20140328862 SEQ ID NO: 229 | 8244 |
| HIV626 | Heavy chain | LSSB2066HC | US20140328862 SEQ ID NO: 230 | 8245 |
| HIV627 | Heavy chain | LSSB2068HC | US20140328862 SEQ ID NO: 231 | 8246 |
| HIV628 | Heavy chain | LSSB2080HC | US20140328862 SEQ ID NO: 232 | 8247 |
| HIV629 | Heavy chain | LSSB2133HC | US20140328862 SEQ ID NO: 233 | 8248 |
| HIV630 | Heavy chain | LSSB2182HC | US20140328862 SEQ ID NO: 234 | 8249 |
| HIV631 | Heavy chain | LSSB218HC | US20140328862 SEQ ID NO: 235 | 8250 |
| HIV632 | Heavy chain | LSSB2277HC | US20140328862 SEQ ID NO: 236 | 8251 |
| HIV633 | Heavy chain | LSSB2288HC | US20140328862 SEQ ID NO: 237 | 8252 |
| HIV634 | Heavy chain | LSSB2339HC | US20140328862 SEQ ID NO: 168 | 8253 |
| HIV635 | Heavy chain | LSSB2351HC | US20140328862 SEQ ID NO: 169 | 8254 |
| HIV636 | Heavy chain | LSSB2361HC | US20140328862 SEQ ID NO: 170 | 8255 |
| HIV637 | Heavy chain | LSSB2364HC | US20140328862 SEQ ID NO: 171 | 8256 |
| HIV638 | Heavy chain | LSSB2367HC | US20140328862 SEQ ID NO: 172 | 8257 |
| HIV639 | Heavy chain | LSSB2416HC | US20140328862 SEQ ID NO: 173 | 8258 |
| HIV640 | Heavy chain | LSSB2434HC | US20140328862 SEQ ID NO: 174 | 8259 |
| HIV641 | Heavy chain | LSSB2483HC | US20140328862 SEQ ID NO: 175 | 8260 |
| HIV642 | Heavy chain | LSSB2490HC | US20140328862 SEQ ID NO: 176 | 8261 |
| HIV643 | Heavy chain | LSSB2503HC | US20140328862 SEQ ID NO: 177 | 8262 |
| HIV644 | Heavy chain | LSSB2525HC | US20140328862 SEQ ID NO: 178 | 8263 |
| HIV645 | Heavy chain | LSSB2530HC | US20140328862 SEQ ID NO: 179 | 8264 |
| HIV646 | Heavy chain | LSSB2538HC | US20140328862 SEQ ID NO: 180 | 8265 |
| HIV647 | Heavy chain | LSSB2554HC | US20140328862 SEQ ID NO: 181 | 8266 |
| HIV648 | Heavy chain | LSSB2573HC | US20140328862 SEQ ID NO: 182 | 8267 |
| HIV649 | Heavy chain | LSSB2578HC | US20140328862 SEQ ID NO: 183 | 8268 |
| HIV650 | Heavy chain | LSSB2586HC | US20140328862 SEQ ID NO: 184 | 8269 |
| HIV651 | Heavy chain | LSSB2609HC | US20140328862 SEQ ID NO: 185 | 8270 |
| HIV652 | Heavy chain | LSSB2612HC | US20140328862 SEQ ID NO: 186 | 8271 |
| HIV653 | Heavy chain | LSSB2630HC | US20140328862 SEQ ID NO: 187 | 8272 |
| HIV654 | Heavy chain | LSSB2640HC | US20S40328862 SEQ ID NO: 188 | 8273 |
| HIV655 | Heavy chain | LSSB2644HC | US20140328862 SEQ ID NO: 189 | 8274 |
| HIV656 | Heavy chain | LSSB2665HC | US20S40328862 SEQ ID NO: 190 | 8275 |
| HIV657 | Heavy chain | LSSB2666HC | US20140328862 SEQ ID NO: 191 | 8276 |
| HIV658 | Heavy chain | LSSB2669HC | US20S40328862 SEQ ID NO: 192 | 8277 |
| HIV659 | Heavy chain | LSSB2680HC | US20140328862 SEQ ID NO: 193 | 8278 |
| HIV660 | Heavy chain | LSSB2683HC | US20S40328862 SEQ ID NO: 194 | 8279 |
| HIV661 | Heavy chain | LSSB331HC | US20140328862 SEQ ID NO: 238 | 8280 |
| HIV662 | Heavy chain | LSSB344HC | US20140328862 SEQ ID NO: 195 | 8281 |
| HIV663 | Heavy chain | LSSNEC101HC | US20140328862 SEQ ID NO: 239 | 8282 |
| HIV664 | Heavy chain | LSSNEC106HC | US20140328862 SEQ ID NO: 240 | 8283 |
| HIV665 | Heavy chain | LSSNEC107HC | US20140328862 SEQ ID NO: 196 | 8284 |
| HIV666 | Heavy chain | LSSNEC108HC | US20140328862 SEQ ID NO: 197 | 8285 |
| HIV667 | Heavy chain | LSSNEC109HC | US20140328862 SEQ ID NO: 198 | 8286 |
| HIV668 | Heavy chain | LSSNEC110HC | US20140328862 SEQ ID NO: 199 | 8287 |
| HIV669 | Heavy chain | LSSNEC112HC | US20140328862 SEQ ID NO: 241 | 8288 |
| HIV670 | Heavy chain | LSSNEC115HC | US20140328862 SEQ ID NO: 242 | 8289 |
| HIV671 | Heavy chain | LSSNEC116HC | US20140328862 SEQ ID NO: 200 | 8290 |
| HIV672 | Heavy chain | LSSNEC117HC | US20140328862 SEQ ID NO: 201 | 8291 |
| HIV673 | Heavy chain | LSSNEC118HC | US20140328862 SEQ ID NO: 202 | 8292 |
| HIV674 | Heavy chain | LSSNEC11HC | US20140328862 SEQ ID NO: 203 | 8293 |

TABLE 42-continued

HIV Antibodies

| Antibody No. | Description | Antibody Name | Reference Information | SEQ ID NO |
|---|---|---|---|---|
| HIV675 | Heavy chain | LSSNEC122HC | US20140328862 SEQ ID NO: 204 | 8294 |
| HIV676 | Heavy chain | LSSNEC123HC | US20140328862 SEQ ID NO: 205 | 8295 |
| HIV677 | Heavy chain | LSSNEC124HC | US20140328862 SEQ ID NO: 243 | 8296 |
| HIV678 | Heavy chain | LSSNEC125HC | US20140328862 SEQ ID NO: 244 | 8297 |
| HIV679 | Heavy chain | LSSNEC126HC | US20140328862 SEQ ID NO: 245 | 8298 |
| HIV680 | Heavy chain | LSSNEC127HC | US20140328862 SEQ ID NO: 206 | 8299 |
| HIV681 | Heavy chain | LSSNEC14HC | US20140328862 SEQ ID NO: 246 | 8300 |
| HIV682 | Heavy chain | LSSNEC16HC | US20140328862 SEQ ID NO: 247 | 8301 |
| HIV683 | Heavy chain | LSSNEC18HC | US20140328862 SEQ ID NO: 207 | 8302 |
| HIV684 | Heavy chain | LSSNEC21HC | US20140328862 SEQ ID NO: 248 | 8303 |
| HIV685 | Heavy chain | LSSNEC24HC | US20140328862 SEQ ID NO: 208 | 8304 |
| HIV686 | Heavy chain | LSSNEC29HC | US20140328862 SEQ ID NO: 209 | 8305 |
| HIV687 | Heavy chain | LSSNEC2HC | US20140328862 SEQ ID NO: 210 | 8306 |
| HIV688 | Heavy chain | LSSNEC30HC | US20140328862 SEQ ID NO: 249 | 8307 |
| HIV689 | Heavy chain | LSSNEC33HC | US20140328862 SEQ ID NO: 211 | 8308 |
| HIV690 | Heavy chain | LSSNEC34HC | US20140328862 SEQ ID NO: 212 | 8309 |
| HIV691 | Heavy chain | LSSNEC3HC | US20140328862 SEQ ID NO: 213 | 8310 |
| HIV692 | Heavy chain | LSSNEC46HC | US20140328862 SEQ ID NO: 214 | 8311 |
| HIV693 | Heavy chain | LSSNEC48HC | US20140328862 SEQ ID NO: 215 | 8312 |
| HIV694 | Heavy chain | LSSNEC49HC | US20140328862 SEQ ID NO: 250 | 8313 |
| HIV695 | Heavy chain | LSSNEC52HC | US20140328862 SEQ ID NO: 216 | 8314 |
| HIV696 | Heavy chain | LSSNEC54HC | US20140328862 SEQ ID NO: 251 | 8315 |
| HIV697 | Heavy chain | LSSNEC55HC | US20140328862 SEQ ID NO: 252 | 8316 |
| HIV698 | Heavy chain | LSSNEC56HC | US20140328862 SEQ ID NO: 217 | 8317 |
| HIV699 | Heavy chain | LSSNEC57HC | US20140328862 SEQ ID NO: 253 | 8318 |
| HIV700 | Heavy chain | LSSNEC5HC | US20140328862 SEQ ID NO: 254 | 8319 |
| HIV701 | Heavy chain | LSSNEC60HC | US20140328862 SEQ ID NO: 218 | 8320 |
| HIV702 | Heavy chain | LSSNEC66HC | US20140328862 SEQ ID NO: 219 | 8321 |
| HIV703 | Heavy chain | LSSNEC67HC | US20140328862 SEQ ID NO: 255 | 8322 |
| HIV704 | Heavy chain | LSSNEC70HC | US20140328862 SEQ ID NO: 220 | 8323 |
| HIV705 | Heavy chain | LSSNEC72HC | US20140328862 SEQ ID NO: 221 | 8324 |
| HIV706 | Heavy chain | LSSNEC74HC | US20140328862 SEQ ID NO: 256 | 8325 |
| HIV707 | Heavy chain | LSSNEC77HC | US20140328862 SEQ ID NO: 257 | 8326 |
| HIV708 | Heavy chain | LSSNEC7HC | US20140328862 SEQ ID NO: 222 | 8327 |
| HIV709 | Heavy chain | LSSNEC82HC | US20140328862 SEQ ID NO: 223 | 8328 |
| HIV710 | Heavy chain | LSSNEC85HC | US20140328862 SEQ ID NO: 258 | 8329 |
| HIV711 | Heavy chain | LSSNEC89HC | US20140328862 SEQ ID NO: 224 | 8330 |
| HIV712 | Heavy chain | LSSNEC8HC | US20140328862 SEQ ID NO: 225 | 8331 |
| HIV713 | Heavy chain | LSSNEC91HC | US20140328862 SEQ ID NO: 259 | 8332 |
| HIV714 | Heavy chain | LSSNEC92HC | US20140328862 SEQ ID NO: 260 | 8333 |
| HIV715 | Heavy chain | LSSNEC94HC | US20140328862 SEQ ID NO: 226 | 8334 |
| HIV716 | Heavy chain | LSSNEC95HC | US20140328862 SEQ ID NO: 227 | 8335 |
| HIV717 | Heavy chain | LSSNEC9HC | US20140328862 SEQ ID NO: 228 | 8336 |
| HIV718 | Heavy chain | m12_Fd-aa | U.S. Pat. No. 7,803,913B2 SEQ ID NO: 3 | 8337 |
| HIV719 | Heavy chain | m14-Fd-aa | U.S. Pat. No. 7,803,913B2 SEQ ID NO: 1 | 8338 |
| HIV720 | Heavy chain | m16-Fd-aa | U.S. Pat. No. 7,803,913B2 SEQ ID NO: 4 | 8339 |
| HIV721 | Heavy chain | m18 Fd-aa | U.S. Pat. No. 7,803,913B2 SEQ ID NO: 2 | 8340 |
| HIV722 | Heavy Chain | M66 | Ofek, G., et al., Structural Basis for HIV-1 Neutralization by 2F5-Like Antibodies m66 and m66.6; J. Virol. 88 (5), 2426-2441 (2014), NCBI Accession # 4NRY_L (220aa) | 8341 |
| HIV723 | Heavy Chain | M66.6 | Ofek, G., et al., Structural Basis for HIV-1 Neutralization by 2F5-Like Antibodies m66 and m66.6; J. Virol. 88 (5), 2426-2441 (2014), NCBI Accession # 4NRZ_H (234aa) | 8342 |
| HIV724 | Heavy Chain | Mab 2158 | Spurrier, B., et al., Functional Implications of the Binding Mode of a Human Conformation-Dependent V2 Monoclonal Antibody against HIV; J. Virol, 88 (8), 4100-4112 (2014), NCBI Accession # 4OAW_D (236aa) | 8343 |
| HIV725 | Heavy chain | MV1 | US20130195881 SEQ ID NO: 10 | 8344 |
| HIV726 | Heavy Chain | Pg16 Fab | Pancera, M., et al., Nat. Struct. Mol. Biol. 20 (7), 804-813 (2013), NCBI Accession # 4DQO_H (246aa) | 8345 |
| HIV727 | Heavy Chain | Pg9 | Willis, J. R., et al., J. Clin. Invest. 125 (6), 2523-2531 (2015), NCBI Accession # 4YAQ_H(248aa) | 8346 |
| HIV728 | Heavy Chain | Pgt121-G1 Fab | Mouquet H et al., Complex-type N-glycan recognition by potent broadly neutralizing HIV antibodies; Proc Natl Acad Sci USA. 2012 Nov. 20; 109(47): E3268-77, NCBI Accession # 4FQQ_B (244aa) | 8347 |

TABLE 42-continued

HIV Antibodies

| Antibody No. | Description | Antibody Name | Reference Information | SEQ ID NO |
|---|---|---|---|---|
| HIV729 | Heavy Chain | Pgt122 | Julien, J. P., et al., PLoS Pathol. 9 (5), E1003342 (2013), NCBI Accession # 4JY5_H (235aa) | 8348 |
| HIV730 | Heavy Chain | Pgt123 | Julien, J. P., et al., PLoS Pathol. 9 (5), E1003342 (2013), NCBI Accession # 4JY6_B (235aa) | 8349 |
| HIV731 | Heavy Chain | Pgt124 | Garces, F., et al., Structural Evolution of Glycan Recognition by a Family of Potent HIV Antibodies; Cell 159 (1), 69-79 (2014), NCBI Accession # 4R26_H (236aa) | 8350 |
| HIV732 | Heavy Chain | Pgt130 | Doores, K. J., et al., J. Virol. 89 (2), 1105-1118 (2015), NCBI Accession # 4RNR_A (233aa) | 8351 |
| HIV733 | Heavy Chain | Pgt135 | Grover et al., Science 343 (6171), 656-661 (2014), NCBI Accession # 4NZR_H (234aa) | 8352 |
| HIV734 | Heavy chain | S19 | US20110059015 SEQ ID NO: 6 | 8353 |
| HIV735 | Heavy chain | S20 | US20110059015 SEQ ID NO: 8 | 8354 |
| HIV736 | Heavy chain | S8 | US20110059015 SEQ ID NO: 4 | 8355 |
| HIV737 | Heavy Chain | Vrc-Pg04 | Wu, X., et al., Focused evolution of HIV-1 neutralizing antibodies revealed by structures and deep sequencing; Science 333 (6049), 1593-1602 (2011)", NCBI Accession # 3SE9_H (228aa) | 8356 |
| HIV738 | Heavy chain | VRC01 | U.S. Pat. No. 8,637,036B2 SEQ ID NO: 1 | 8357 |
| HIV739 | Heavy chain | VRC01HC/VRCO3LC | WO2013090644 SEQ ID NO: 2 | 8358 |
| HIV740 | Heavy chain | VRC02 | U.S. Pat. No. 8,637,036B2 SEQ ID NO: 3 | 8359 |
| HIV741 | Heavy chain | VRC03 | U.S. Pat. No. 8,637,036B2 SEQ ID NO: 27 | 8360 |
| HIV742 | Heavy chain | VRC03HC-VRC01LC | WO2013090644 SEQ ID NO: 32 | 8361 |
| HIV743 | Heavy chain | VRC07 G54H, S58N | US20140322163 SEQ ID NO: 258 | 8362 |
| HIV744 | Heavy chain | VRC07 I37V, G54H, S58N, T93A | US20140322163 SEQ ID NO: 260 | 8363 |
| HIV745 | Heavy chain | VRC07 I37V, G54H, T93A | US20140322163 SEQ ID NO: 259 | 8364 |
| HIV746 | Heavy Chain | Vrc08c | Wu, X., et al., Maturation and Diversity of the VRC01-Antibody Lineage over 15 Years of Chronic HIV-1 Infection; Cell 161 (3), 470-485 (2015), NCBI Accession # 4XNY_H (235aa) | 8365 |
| HIV747 | Heavy Chain | Vrc23 | Georgiev, I. S., et al., Delineating antibody recognition in polyclonal sera from patterns of HIV-1 isolate neutralization; Science 340 (6133), 751-756 (2013), NCBI Accession # 4J6R_H (224aa) | 8366 |
| HIV748 | Heavy chain | VRC-CH30 | WO2013090644 SEQ ID NO: 22 | 8367 |
| HIV749 | Heavy Chain | Vrc-ch31 | Zhou T et al., Immunity 39 (2), 245-258 (2013), NCBI Accession # 4LSP_H (236aa) | 8368 |
| HIV750 | Heavy chain | VRC-CH32 | Wu X. et al, "Focused evolution of HIV-1 neutralizing antibodies revealed by structures and deep sequencing" Science 333 (6049), 1593-1602 (2011), NCBI Accession # AEM62724 | 8369 |
| HIV751 | Heavy chain | VRC-CH33 | WO2013090644 SEQ ID NO: 28 | 8370 |
| HIV752 | Heavy chain | VRC-CH34 | WO2013090644 SEQ ID NO: 30 | 8371 |
| HIV753 | Heavy chain | VRCO7 G54H | US20140322163 SEQ ID NO: 33 | 8372 |
| HIV754 | Heavy chain | VRC-PG04 | Wu X. et al, "Focused evolution of HIV-1 neutralizing antibodies revealed by structures and deep sequencing" Science 333 (6049), 1593-1602 (2011), NCBI Accession # AEM62752 | 8373 |
| HIV755 | Heavy chain | VRC-PG04b | WO2013090644 SEQ ID NO: 44 | 8374 |
| HIV756 | Heavy Chain | Vrc-pg20 | Zhou T et al., Immunity 39 (2), 245-258 (2013), NCBI Accession # 4LSU_H (227aa) | 8375 |
| HIV757 | Heavy chain | X5 | U.S. Pat. No. 7,378,093B2 SEQ ID NO: 3 | 8376 |
| HIV758 | Heavy chain | X5 | U.S. Pat. No. 8,110,192B2 SEQ ID NO: 5 | 8377 |
| HIV759 | Heavy chain | X5 variant | U.S. Pat. No. 7,378,093B2 SEQ ID NO: 11 | 8378 |
| HIV760 | Heavy Chain | Z13e1 | Stanfield, R. L., et al, J. Mol. Biol. 414 (3). 460-476 (2011), NCBI Accession # 3Q1S_H(230aa) | 8379 |
| HIV761 | Heavy Chain | Z258-vrc27.01 | Zhou. T et al., Structural Repertoire of HIV-1-Neutralizing Antibodies Targeting the CD4 Supersite in 14 Donors; Cell 161 (6), 1280-1292 (2015), NCBI Accession # 4YDI_H(227aa) | 8380 |

TABLE 42-continued

HIV Antibodies

| Antibody No. | Description | Antibody Name | Reference Information | SEQ ID NO |
|---|---|---|---|---|
| HIV762 | Heavy Chain | | NCBI Accession # 1N0X_K (230aa) | 8381 |
| HIV763 | Heavy chain | | U.S. Pat. No. 5,804,440A SEQ ID NO: 142 | 8382 |
| HIV764 | Heavy chain | | U.S. Pat. No. 5,804,440A SEQ ID NO: 143 | 8383 |
| HIV765 | Heavy chain | | U.S. Pat. No. 5,804,440A SEQ ID NO: 144 | 8384 |
| HIV766 | Heavy chain | | U.S. Pat. No. 5,804,440A SEQ ID NO: 145 | 8385 |
| HIV767 | Heavy chain | | U.S. Pat. No. 5,804,440A SEQ ID NO: 146 | 8386 |
| HIV768 | Heavy chain | | U.S. Pat. No. 5,804,440A SEQ ID NO: 66 | 8387 |
| HIV769 | Heavy chain | | U.S. Pat. No. 5,804,440A SEQ ID NO: 67 | 8388 |
| HIV770 | Heavy chain | | U.S. Pat. No. 5,804,440A SEQ ID NO: 68 | 8389 |
| HIV771 | Heavy chain | | U.S. Pat. No. 5,804,440A SEQ ID NO: 70 | 8390 |
| HIV772 | Heavy chain | | U.S. Pat. No. 5,804,440A SEQ ID NO: 72 | 8391 |
| HIV773 | Heavy chain | | U.S. Pat. No. 5,804,440A SEQ ID NO: 73 | 8392 |
| HIV774 | Heavy chain | | U.S. Pat. No. 5,804,440A SEQ ID NO: 74 | 8393 |
| HIV775 | Heavy chain | | U.S. Pat. No. 5,804,440A SEQ ID NO: 75 | 8394 |
| HIV776 | Heavy chain | | U.S. Pat. No. 5,804,440A SEQ ID NO: 78 | 8395 |
| HIV777 | Heavy chain | | WO2014063059 SEQ ID NO: 10 | 8396 |
| HIV778 | Heavy chain | | WO2014063059 SEQ ID NO: 12 | 8397 |
| HIV779 | Heavy chain | | WO2014063059 SEQ ID NO: 130 | 8398 |
| HIV780 | Heavy chain | | WO2014063059 SEQ ID NO: 14 | 8399 |
| HIV781 | Heavy chain | | WO2014063059 SEQ ID NO: 16 | 8400 |
| HIV782 | Heavy chain | | WO2014063059 SEQ ID NO: 18 | 8401 |
| HIV783 | Heavy chain | | WO2014063059 SEQ ID NO: 20 | 8402 |
| HIV784 | Heavy chain | | WO2014063059 SEQ ID NO: 22 | 8403 |
| HIV785 | Heavy chain | | WO2014063059 SEQ ID NO: 24 | 8404 |
| HIV786 | Heavy chain | | WO2014063059 SEQ ID NO: 4 | 8405 |
| HIV787 | Heavy chain | | WO2014063059 SEQ ID NO: 6 | 8406 |
| HIV788 | Heavy chain | | WO2014063059 SEQ ID NO: 8 | 8407 |
| HIV789 | Heavy chain consensus | | WO2014063059 SEQ ID NO: 2 | 8408 |
| HIV790 | Heavy chain constant region | G4D | US20130195881 SEQ ID NO: 6 | 8409 |
| HIV791 | Heavy chain constant region | G4H | US20130195881 SEQ ID NO: 5 | 8410 |
| HIV792 | Heavy chain constant region | MV1 | US20130195881 SEQ ID NO: 7 | 8411 |
| HIV793 | Heavy chain constant region | TNX-355, Idalizumab | US20130195881 SEQ ID NO: 4 | 8412 |
| HIV794 | Heavy Chain Fab | Ch04 | McLellan, J. S., et al. Nature 480 (7377), 336-343 (2011), NCBI Accession # 3U46_A (238aa) | 8413 |
| HIV795 | Heavy Chain Of Anti-HIV Fab From Human 21c Antibody | 21C | Diskin, R., et al, Nat. Struct. Mol. Biol. 17 (5), 608-613 (2010), NCBI Accession # 3LMJ_H (231aa) | 8414 |
| HIV796 | Heavy Chain Of Anti-hiv-1 Gp120 V1v2 Antibody 830a | 830a | Pan et al, J. Virol. 89 (15), 8003-8010 (2015), NCBI Accession # 4YWG_H (226aa) | 8415 |
| HIV797 | Heavy chain partial | 412D | Huang C. et al "Structural basis of tyrosine sulfation and VH-gene usage in antibodies that recognize the HIV type 1 coreceptor-binding site on gp120" Proc. Natl. Acad. Sci. U.S.A. 101 (9), 2706-2711 (2004), NCBI Accession # AAR88379 | 8416 |
| HIV798 | Heavy chain variable region | 0.5γ(1C10) | U.S. Pat. No. 8,722,861B2 SEQ ID NO: 1 | 8417 |
| HIV799 | Heavy chain variable region | 0.5δ (3D6) | U.S. Pat. No. 8,722,861B2 SEQ ID NO: 5 | 8418 |
| HIV800 | Heavy chain variable region | 10J4 mAb | WO2015103549 SEQ ID NO: 3 | 8419 |
| HIV801 | Heavy chain variable region | 10M6 mAb | WO2015103549 SEQ ID NO: 5 | 8420 |
| HIV802 | Heavy chain variable region | 13110 mAb | WO2015103549 SEQ ID NO: 7 | 8421 |
| HIV803 | Heavy chain variable region | 2N5mAb | WO2015103549 SEQ ID NO: 9 | 8422 |
| HIV804 | Heavy chain variable region | 35022 mAb | WO2015103549 SEQ ID NO: 1 | 8423 |
| HIV805 | Heavy chain variable region | 42F9 | U.S. Pat. No. 8,722,861B2 SEQ ID NO: 7 | 8424 |
| HIV806 | Heavy chain variable region | 4835_F12 (PGT-124) | US20140205612 SEQ ID NO: 404 | 8425 |
| HIV807 | Heavy chain variable region | 4838_L06 (PGT-121) | US20140205612 SEQ ID NO: 66 | 8426 |
| HIV808 | Heavy chain variable region | 4858_P08 (PGT-123) | US20140205612 SEQ ID NO: 167 | 8427 |

TABLE 42-continued

HIV Antibodies

| Antibody No. | Description | Antibody Name | Reference Information | SEQ ID NO |
|---|---|---|---|---|
| HIV809 | Heavy chain variable region | 4869-K15 (PGT-133) | US20140205612 SEQ ID NO: 419 | 8428 |
| HIV810 | Heavy chain variable region | 4873_E03 (PGT-121) | US20140205612 SEQ ID NO: 62 | 8429 |
| HIV811 | Heavy chain variable region | 4876_M06 (PGT-134) | US20140205612 SEQ ID NO: 434 | 8430 |
| HIV812 | Heavy chain variable region | 4877_D15 (PGT-122) | US20140205612 SEQ ID NO: 155 | 8431 |
| HIV813 | Heavy chain variable region | 4964_G22 (PGT-141), 4993_K13 (PGT-141) | US20140205612 SEQ ID NO: 275 | 8432 |
| HIV814 | Heavy chain variable region | 4970_K22 (PGT-144) | US20140205612 SEQ ID NO: 306 | 8433 |
| HIV815 | Heavy chain variable region | 4980_N08 (PGT-143) | US20140205612 SEQ ID NO: 297 | 8434 |
| HIV816 | Heavy chain variable region | 4995_E20 (PGT-142) | US20140205612 SEQ ID NO: 291 | 8435 |
| HIV817 | Heavy chain variable region | 4995_P16 (PGT-145) | US20140205612 SEQ ID NO: 400 | 8436 |
| HIV818 | Heavy chain variable region | 49G2 | U.S. Pat. No. 8,722,861B2 SEQ ID NO: 9 | 8437 |
| HIV819 | Heavy chain variable region | 4O20mAb | WO2015103549 SEQ ID NO: 11 | 8438 |
| HIV820 | Heavy chain variable region | 5114_A19 (PGT-128) | US20140205612 SEQ ID NO: 333 | 8439 |
| HIV821 | Heavy chain variable region | 5120_N10 (PGT-139) | US20140205612 SEQ ID NO: 462 | 8440 |
| HIV822 | Heavy chain variable region | 5131_A17 (PGT-132) | US20140205612 SEQ ID NO: 443 | 8441 |
| HIV823 | Heavy chain variable region | 5136_H01 (PGT-131) | US20140205612 SEQ ID NO: 345 | 8442 |
| HIV824 | Heavy chain variable region | 5138_G07 (PGT-138) | US20140205612 SEQ ID NO: 453 | 8443 |
| HIV825 | Heavy chain variable region | 5141_B17 (PGT-126) | US20140205612 SEQ ID NO: 199 | 8444 |
| HIV826 | Heavy chain variable region | 5145_B14 (PGT-127) | US20140205612 SEQ ID NO: 318 | 8445 |
| HIV827 | Heavy chain variable region | 5147_N06 (PGT-130) | US20140205612 SEQ ID NO: 215 | 8446 |
| HIV828 | Heavy chain variable region | 5329_C19 (PGT-136), 5366_P21 (PGT-136) | US20140205612 SEQ ID NO: 248 | 8447 |
| HIV829 | Heavy chain variable region | 5343_B08 (PGT-135), 5344_E16 (PGT-135) | US20140205612 SEQ ID NO: 231 | 8448 |
| HIV830 | Heavy chain variable region | 5345_I01 (PGT-137) | US20140205612 SEQ ID NO: 362 | 8449 |
| HIV831 | Heavy chain variable region | 5G2 | U.S. Pat. No. 8,722,861B2 SEQ ID NO: 3 | 8450 |
| HIV832 | Heavy chain variable region | 6808_B09 (PGT-156) | US20140205612 SEQ ID NO: 546 | 8451 |
| HIV833 | Heavy chain variable region | 6831_A21 (PGT-151) | US20140205612 SEQ ID NO: 473 | 8452 |
| HIV834 | Heavy chain variable region | 6843_G20 (PGT-154) | US20140205612 SEQ ID NO: 516 | 8453 |
| HIV835 | Heavy chain variable region | 6881_N05 (PGT-158). | US20140205612 SEQ ID NO: 572 | 8454 |
| HIV836 | Heavy chain variable region | 6889_I17 (PGT-152) | US20140205612 SEQ ID NO: 489 | 8455 |
| HIV837 | Heavy chain variable region | 6891_F06 (PGT-153) | US20140205612 SEQ ID NO: 501 | 8456 |
| HIV838 | Heavy chain variable region | 6892_C23 (PGT-157) | US20140205612 SEQ ID NO: 559 | 8457 |
| HIV839 | Heavy chain variable region | 6892_D19 (PGT-155) | US20140205612 SEQ ID NO: 531 | 8458 |
| HIV840 | Heavy chain variable region | 7B9mAb | WO2015103549 SEQ ID NO: 13 | 8459 |
| HIV841 | Heavy chain variable region | 7K3mAb | WO2015103549 SEQ ID NO: 15 | 8460 |
| HIV842 | Heavy chain variable region | B4 | U.S. Pat. No. 7,872,110B2 SEQ ID NO: 2 | 8461 |

TABLE 42-continued

| | | HIV Antibodies | | |
|---|---|---|---|---|
| Antibody No. | Description | Antibody Name | Reference Information | SEQ ID NO |
| HIV843 | Heavy chain variable region | B4DIVHv.1 | U.S. Pat. No. 7,872,110B2 SEQ ID NO: 5 | 8462 |
| HIV844 | Heavy chain variable region | B4DIVHv.2 | U.S. Pat. No. 7,872,110B2 SEQ ID NO: 6 | 8463 |
| HIV845 | Heavy chain variable region | B4DTVHv.3 | U.S. Pat. No. 7,872,110B2 SEQ ID NO: 7 | 8464 |
| HIV846 | Heavy chain variable region | B4DIVHv.4 | U.S. Pat. No. 7,872,110B2 SEQ ID NO: 8 | 8465 |
| HIV847 | Heavy chain variable region | bI2 IgA2 antibody | WO2014040024 SEQ ID NO: 29 | 8466 |
| HIV848 | Heavy chain variable region | CHμ39.1 | U.S. Pat. No. 5,773,247 SEQ ID NO: 10 | 8467 |
| HIV849 | Heavy chain variable region | CHμ5.5 | U.S. Pat. No. 5,773,247 SEQ ID NO: 14 | 8468 |
| HIV850 | Heavy chain variable region | F425-Alg8 antibody | WO2014040024 SEQ ID NO: 9 | 8469 |
| HIV851 | Heavy chain variable region | Fab 43 | US20090191216 SEQ ID NO: 8 | 8470 |
| HIV852 | Heavy chain variable region | HGN194 | US20110212106 SEQ ID NO: 45 | 8471 |
| HIV853 | Heavy chain variable region | HJ16 | US20110212106 SEQ ID NO: 13 | 8472 |
| HIV854 | Heavy chain variable region | HK20 | US20110212106 SEQ ID NO: 29 | 8473 |
| HIV855 | Heavy chain variable region | IgA antibody | WO2014040024 SEQ ID NO: 11 | 8474 |
| HIV856 | Heavy chain variable region | L1719A11 | US20150158934 SEQ ID NO: 175 | 8475 |
| HIV857 | Heavy chain variable region | L1719A12 | US20150158934 SEQ ID NO: 176 | 8476 |
| HIV858 | Heavy chain variable region | L1719A9 | US20150158934 SEQ ID NO: 174 | 8477 |
| HIV859 | Heavy chain variable region | L1719B12 | US20150158934 SEQ ID NO: 177 | 8478 |
| HIV860 | Heavy chain variable region | L1719C1 | US20150158934 SEQ ID NO: 178 | 8479 |
| HIV861 | Heavy chain variable region | L1719D10 | US20150158934 SEQ ID NO: 179 | 8480 |
| HIV862 | Heavy chain variable region | L1719E1 | US20150158934 SEQ ID NO: 180 | 8481 |
| HIV863 | Heavy chain variable region | L1719E11 | US20150158934 SEQ ID NO: 181 | 8482 |
| HIV864 | Heavy chain variable region | L1719E12 | US20150158934 SEQ ID NO: 182 | 8483 |
| HIV865 | Heavy chain variable region | L1719F11 | US20150158934 SEQ ID NO: 183 | 8484 |
| HIV866 | Heavy chain variable region | L1719H10 | US20150158934 SEQ ID NO: 185 | 8485 |
| HIV867 | Heavy chain variable region | L1719H9 | US20150158934 SEQ ID NO: 184 | 8486 |
| HIV868 | Heavy chain variable region | L1720C1 | US20150158934 SEQ ID NO: 186 | 8487 |
| HIV869 | Heavy chain variable region | L1720E4 | US20150158934 SEQ ID NO: 187 | 8488 |
| HIV870 | Heavy chain variable region | L1721A3 | US20150158934 SEQ ID NO: 188 | 8489 |
| HIV871 | Heavy chain variable region | L1721A5 | US20150158934 SEQ ID NO: 189 | 8490 |
| HIV872 | Heavy chain variable region | L1721A8 | US20150158934 SEQ ID NO: 190 | 8491 |
| HIV873 | Heavy chain variable region | L1721H4 | US20150158934 SEQ ID NO: 191 | 8492 |
| HIV874 | Heavy chain variable region | L1723A10 | US20150158934 SEQ ID NO: 193 | 8493 |
| HIV875 | Heavy chain variable region | L1723A11 | US20150158934 SEQ ID NO: 194 | 8494 |
| HIV876 | Heavy chain variable region | L1723A9 | US20150158934 SEQ ID NO: 192 | 8495 |
| HIV877 | Heavy chain variable region | L1723E5 | US20150158934 SEQ ID NO: 195 | 8496 |
| HIV878 | Heavy chain variable region | L2319G11 | US20150158934 SEQ ID NO: 197 | 8497 |
| HIV879 | Heavy chain variable region | L2319G7 | US20150158934 SEQ ID NO: 196 | 8498 |

TABLE 42-continued

HIV Antibodies

| Antibody No. | Description | Antibody Name | Reference Information | SEQ ID NO |
|---|---|---|---|---|
| HIV880 | Heavy chain variable region | L2319H7 | US20150158934 SEQ ID NO: 198 | 8499 |
| HIV881 | Heavy chain variable region | L2320E9 | US20150158934 SEQ ID NO: 199 | 8500 |
| HIV882 | Heavy chain variable region | L2320F9 | US20150158934 SEQ ID NO: 200 | 8501 |
| HIV883 | Heavy chain variable region | L2321B7 | US20150158934 SEQ ID NO: 201 | 8502 |
| HIV884 | Heavy chain variable region | L2321H6 | US20150158934 SEQ ID NO: 202 | 8503 |
| HIV885 | Heavy chain variable region | L81C11 | US20150158934 SEQ ID NO: 15 | 8504 |
| HIV886 | Heavy chain variable region | L81C9 | US20150158934 SEQ ID NO: 30 | 8505 |
| HIV887 | Heavy chain variable region | L81D9 | US20150158934 SEQ ID NO: 10 | 8506 |
| HIV888 | Heavy chain variable region | L81E1 | US20150158934 SEQ ID NO: 18 | 8507 |
| HIV889 | Heavy chain variable region | L81E7 | US20150158934 SEQ ID NO: 16 | 8508 |
| HIV890 | Heavy chain variable region | L81F1 | US20150158934 SEQ ID NO: 19 | 8509 |
| HIV891 | Heavy chain variable region | L81G7 | US20150158934 SEQ ID NO: 13 | 8510 |
| HIV892 | Heavy chain variable region | L81H1 | US20150158934 SEQ ID NO: 98 | 8511 |
| HIV893 | Heavy chain variable region | L81H2 | US20150158934 SEQ ID NO: 23 | 8512 |
| HIV894 | Heavy chain variable region | L81H7 | US20150158934 SEQ ID NO: 11 | 8513 |
| HIV895 | Heavy chain variable region | L81H9 | US20150158934 SEQ ID NO: 28 | 8514 |
| HIV896 | Heavy chain variable region | L82B12A | US20150158934 SEQ ID NO: 105 | 8515 |
| HIV897 | Heavy chain variable region | L82B1A | US20150158934 SEQ ID NO: 99 | 8516 |
| HIV898 | Heavy chain variable region | L82B1D | US20150158934 SEQ ID NO: 100 | 8517 |
| HIV899 | Heavy chain variable region | L82B2A | US20150158934 SEQ ID NO: 101 | 8518 |
| HIV900 | Heavy chain variable region | L82B3F | US20150158934 SEQ ID NO: 102 | 8519 |
| HIV901 | Heavy chain variable region | L82B4A | US20150158934 SEQ ID NO: 103 | 8520 |
| HIV902 | Heavy chain variable region | L82B4E | US20150158934 SEQ ID NO: 104 | 8521 |
| HIV903 | Heavy chain variable region | L82B4F | US20150158934 SEQ ID NO: 21 | 8522 |
| HIV904 | Heavy chain variable region | L832G6 | US20150158934 SEQ ID NO: 113 | 8523 |
| HIV905 | Heavy chain variable region | L833E1 | US20150158934 SEQ ID NO: 72 | 8524 |
| HIV906 | Heavy chain variable region | L833F5 | US20150158934 SEQ ID NO: 17 | 8525 |
| HIV907 | Heavy chain variable region | L833H1 | US20150158934 SEQ ID NO: 114 | 8526 |
| HIV908 | Heavy chain variable region | L833H3 | US20150158934 SEQ ID NO: 115 | 8527 |
| HIV909 | Heavy chain variable region | L88B10B | US20150158934 SEQ ID NO: 27 | 8528 |
| HIV910 | Heavy chain variable region | L88B11B | US20150158934 SEQ ID NO: 12 | 8529 |
| HIV911 | Heavy chain variable region | L88B12G | US20150158934 SEQ ID NO: 29 | 8530 |
| HIV912 | Heavy chain variable region | L88B1D | US20150158934 SEQ ID NO: 20 | 8531 |
| HIV913 | Heavy chain variable region | L88B2A | US20150158934 SEQ ID NO: 106 | 8532 |
| HIV914 | Heavy chain variable region | L88FA2 | US20150158934 SEQ ID NO: 26 | 8533 |
| HIV915 | Heavy chain variable region | L88FA3 | US20150158934 SEQ ID NO: 107 | 8534 |
| HIV916 | Heavy chain variable region | L88FA5 | US20150158934 SEQ ID NO: 108 | 8535 |

TABLE 42-continued

HIV Antibodies

| Antibody No. | Description | Antibody Name | Reference Information | SEQ ID NO |
|---|---|---|---|---|
| HIV917 | Heavy chain variable region | L88FB1 | US20150158934 SEQ ID NO: 25 | 8536 |
| HIV918 | Heavy chain variable region | L88FC11 | US20150158934 SEQ ID NO: 22 | 8537 |
| HIV919 | Heavy chain variable region | L88FD12 | US20150158934 SEQ ID NO: 24 | 8538 |
| HIV920 | Heavy chain variable region | L89B12D | US20150158934 SEQ ID NO: 112 | 8539 |
| HIV921 | Heavy chain variable region | L89B1D | US20150158934 SEQ ID NO: 109 | 8540 |
| HIV922 | Heavy chain variable region | L89B2C | US20150158934 SEQ ID NO: 110 | 8541 |
| HIV923 | Heavy chain variable region | L89B3E | US20150158934 SEQ ID NO: 14 | 8542 |
| HIV924 | Heavy chain variable region | L89B6B | US20150158934 SEQ ID NO: 111 | 8543 |
| HIV925 | Heavy chain variable region | L8Cb15 | US20150158934 SEQ ID NO: 116 | 8544 |
| HIV926 | Heavy chain variable region | L8Cj3 | US20150158934 SEQ ID NO: 73 | 8545 |
| HIV927 | Heavy chain variable region | L8Fe2 | US20150158934 SEQ ID NO: 117 | 8546 |
| HIV928 | Heavy chain variable region | L8Fg12 | US20150158934 SEQ ID NO: 118 | 8547 |
| HIV929 | Heavy chain variable region | L8Fj19 | US20150158934 SEQ ID NO: 119 | 8548 |
| HIV930 | Heavy chain variable region | L8Fo17 | US20150158934 SEQ ID NO: 120 | 8549 |
| HIV931 | Heavy chain variable region | L8Fp6 | US20150158934 SEQ ID NO: 121 | 8550 |
| HIV932 | Heavy chain variable region | L8Hi20 | US20150158934 SEQ ID NO: 122 | 8551 |
| HIV933 | Heavy chain variable region | L911B11E | US20150158934 SEQ ID NO: 140 | 8552 |
| HIV934 | Heavy chain variable region | L911B12B | US20150158934 SEQ ID NO: 71 | 8553 |
| HIV935 | Heavy chain variable region | L911B1E | US20150158934 SEQ ID NO: 137 | 8554 |
| HIV936 | Heavy chain variable region | L911B1G | US20150158934 SEQ ID NO: 65 | 8555 |
| HIV937 | Heavy chain variable region | L911B2E | US20150158934 SEQ ID NO: 138 | 8556 |
| HIV938 | Heavy chain variable region | L911B3D | US20150158934 SEQ ID NO: 75 | 8557 |
| HIV939 | Heavy chain variable region | L911B9A | US20150158934 SEQ ID NO: 139 | 8558 |
| HIV940 | Heavy chain variable region | L911F12B | US20150158934 SEQ ID NO: 142 | 8559 |
| HIV941 | Heavy chain variable region | L911F1B | US20150158934 SEQ ID NO: 141 | 8560 |
| HIV942 | Heavy chain variable region | L911F1F | US20150158934 SEQ ID NO: 77 | 8561 |
| HIV943 | Heavy chain variable region | L911F4C | US20150158934 SEQ ID NO: 33 | 8562 |
| HIV944 | Heavy chain variable region | L91A1 | US20150158934 SEQ ID NO: 123 | 8563 |
| HIV945 | Heavy chain variable region | L91B5 | US20150158934 SEQ ID NO: 37 | 8564 |
| HIV946 | Heavy chain variable region | L91B5, 4A7 | US20150158934 SEQ ID NO: 97 | 8565 |
| HIV947 | Heavy chain variable region | L91B5, A12 | US20150158934 SEQ ID NO: 92 | 8566 |
| HIV948 | Heavy chain variable region | L91B5, A4 | US20150158934 SEQ ID NO: 90 | 8567 |
| HIV949 | Heavy chain variable region | L91B5, A7 | US20150158934 SEQ ID NO: 91 | 8568 |
| HIV950 | Heavy chain variable region | L91B5, B2 | US20150158934 SEQ ID NO: 93 | 8569 |
| HIV951 | Heavy chain variable region | L91B5, D4 | US20150158934 SEQ ID NO: 94 | 8570 |
| HIV952 | Heavy chain variable region | L91B5, F11 | US20150158934 SEQ ID NO: 96 | 8571 |
| HIV953 | Heavy chain variable region | L91B5, F4 | US20150158934 SEQ ID NO: 95 | 8572 |

TABLE 42-continued

HIV Antibodies

| Antibody No. | Description | Antibody Name | Reference Information | SEQ ID NO |
|---|---|---|---|---|
| HIV954 | Heavy chain variable region | L91C2 | US20150158934 SEQ ID NO: 61 | 8573 |
| HIV955 | Heavy chain variable region | L91E1 | US20150158934 SEQ ID NO: 45 | 8574 |
| HIV956 | Heavy chain variable region | L91E2 | US20150158934 SEQ ID NO: 124 | 8575 |
| HIV957 | Heavy chain variable region | L91F10 | US20150158934 SEQ ID NO: 69 | 8576 |
| HIV958 | Heavy chain variable region | L91G2 | US20150158934 SEQ ID NO: 64 | 8577 |
| HIV959 | Heavy chain variable region | L91H3 | US20150158934 SEQ ID NO: 128 | 8578 |
| HIV960 | Heavy chain variable region | L91H9 | US20150158934 SEQ ID NO: 41 | 8579 |
| HIV961 | Heavy chain variable region | L922B2 | US20150158934 SEQ ID NO: 143 | 8580 |
| HIV962 | Heavy chain variable region | L922B4 | US20150158934 SEQ ID NO: 144 | 8581 |
| HIV963 | Heavy chain variable region | L922E1 | US20150158934 SEQ ID NO: 145 | 8582 |
| HIV964 | Heavy chain variable region | L922E2 | US20150158934 SEQ ID NO: 53 | 8583 |
| HIV965 | Heavy chain variable region | L923A1 | US20150158934 SEQ ID NO: 146 | 8584 |
| HIV966 | Heavy chain variable region | L923A4 | US20150158934 SEQ ID NO: 32 | 8585 |
| HIV967 | Heavy chain variable region | L92A11 | US20150158934 SEQ ID NO: 125 | 8586 |
| HIV968 | Heavy chain variable region | L92C7 | US20150158934 SEQ ID NO: 62 | 8587 |
| HIV969 | Heavy chain variable region | L92D4 | US20150158934 SEQ ID NO: 126 | 8588 |
| HIV970 | Heavy chain variable region | L92E6 | US20150158934 SEQ ID NO: 63 | 8589 |
| HIV971 | Heavy chain variable region | L92E7 | US20150158934 SEQ ID NO: 74 | 8590 |
| HIV972 | Heavy chain variable region | L92E7, A1 | US20150158934 SEQ ID NO: 85 | 8591 |
| HIV973 | Heavy chain variable region | L92E7, A2 | US20150158934 SEQ ID NO: 86 | 8592 |
| HIV974 | Heavy chain variable region | L92E7, A3 | US20150158934 SEQ ID NO: 87 | 8593 |
| HIV975 | Heavy chain variable region | L92E7, A4 | US20150158934 SEQ ID NO: 80 | 8594 |
| HIV976 | Heavy chain variable region | L92E7, A4 | US20150158934 SEQ ID NO: 88 | 8595 |
| HIV977 | Heavy chain variable region | L92E7, A5 | US20150158934 SEQ ID NO: 89 | 8596 |
| HIV978 | Heavy chain variable region | L92E7, B5 | US20150158934 SEQ ID NO: 78 | 8597 |
| HIV979 | Heavy chain variable region | L92E7. C | US20150158934 SEQ ID NO: 79 | 8598 |
| HIV980 | Heavy chain variable region | L92E7, C3 | US20150158934 SEQ ID NO: 82 | 8599 |
| HIV981 | Heavy chain variable region | L92E7, D3 | US20150158934 SEQ ID NO: 83 | 8600 |
| HIV982 | Heavy chain variable region | L92E7, E1 | US20150158934 SEQ ID NO: 84 | 8601 |
| HIV983 | Heavy chain variable region | L92E7, G4 | US20150158934 SEQ ID NO: 81 | 8602 |
| HIV984 | Heavy chain variable region | L932A9 | US20150158934 SEQ ID NO: 58 | 8603 |
| HIV985 | Heavy chain variable region | L932E10 | US20150158934 SEQ ID NO: 35 | 8604 |
| HIV986 | Heavy chain variable region | L932E8 | US20150158934 SEQ ID NO: 147 | 8605 |
| HIV987 | Heavy chain variable region | L932G9 | US20150158934 SEQ ID NO: 34 | 8606 |
| HIV988 | Heavy chain variable region | L933D10 | US20150158934 SEQ ID NO: 50 | 8607 |
| HIV989 | Heavy chain variable region | L93B3 | US20150158934 SEQ ID NO: 70 | 8608 |
| HIV990 | Heavy chain variable region | L93B4 | US20150158934 SEQ ID NO: 127 | 8609 |

TABLE 42-continued

| Antibody No. | Description | Antibody Name | Reference Information | SEQ ID NO |
|---|---|---|---|---|
| HIV991 | Heavy chain variable region | L93C3 | US20150158934 SEQ ID NO: 51 | 8610 |
| HIV992 | Heavy chain variable region | L93C6 | US20150158934 SEQ ID NO: 67 | 8611 |
| HIV993 | Heavy chain variable region | L93D3 | US20150158934 SEQ ID NO: 129 | 8612 |
| HIV994 | Heavy chain variable region | L93D4 | US20150158934 SEQ ID NO: 43 | 8613 |
| HIV995 | Heavy chain variable region | L93D9 | US20150158934 SEQ ID NO: 130 | 8614 |
| HIV996 | Heavy chain variable region | L93E3 | US20150158934 SEQ ID NO: 55 | 8615 |
| HIV997 | Heavy chain variable region | L93E6 | US20150158934 SEQ ID NO: 131 | 8616 |
| HIV998 | Heavy chain variable region | L93F12 | US20150158934 SEQ ID NO: 133 | 8617 |
| HIV999 | Heavy chain variable region | L93F2 | US20150158934 SEQ ID NO: 132 | 8618 |
| HIV1000 | Heavy chain variable region | L93F2 | US20150158934 SEQ ID NO: 59 | 8619 |
| HIV1001 | Heavy chain variable region | L93H6 | US20150158934 SEQ ID NO: 38 | 8620 |
| HIV1002 | Heavy chain variable region | L93H9 | US20150158934 SEQ ID NO: 134 | 8621 |
| HIV1003 | Heavy chain variable region | L94A12 | US20150158934 SEQ ID NO: 46 | 8622 |
| HIV1004 | Heavy chain variable region | L94C2 | US20150158934 SEQ ID NO: 31 | 8623 |
| HIV1005 | Heavy chain variable region | L94D12 | US20150158934 SEQ ID NO: 42 | 8624 |
| HIV1006 | Heavy chain variable region | L94D4 | US20150158934 SEQ ID NO: 47 | 8625 |
| HIV1007 | Heavy chain variable region | L94E3 | US20150158934 SEQ ID NO: 39 | 8626 |
| HIV1008 | Heavy chain variable region | L94E4 | US20150158934 SEQ ID NO: 54 | 8627 |
| HIV1009 | Heavy chain variable region | L94E5 | US20150158934 SEQ ID NO: 57 | 8628 |
| HIV1010 | Heavy chain variable region | L94H1 | US20150158934 SEQ ID NO: 36 | 8629 |
| HIV1011 | Heavy chain variable region | L94H2 | US20150158934 SEQ ID NO: 40 | 8630 |
| HIV1012 | Heavy chain variable region | L94H5 | US20150158934 SEQ ID NO: 48 | 8631 |
| HIV1013 | Heavy chain variable region | L94H7 | US20150158934 SEQ ID NO: 135 | 8632 |
| HIV1014 | Heavy chain variable region | L95B10D | US20150158934 SEQ ID NO: 136 | 8633 |
| HIV1015 | Heavy chain variable region | L95B12A | US20150158934 SEQ ID NO: 68 | 8634 |
| HIV1016 | Heavy chain variable region | L95B12E | US20150158934 SEQ ID NO: 66 | 8635 |
| HIV1017 | Heavy chain variable region | L95B8A | US20150158934 SEQ ID NO: 60 | 8636 |
| HIV1018 | Heavy chain variable region | L98FB10 | US20150158934 SEQ ID NO: 76 | 8637 |
| HIV1019 | Heavy chain variable region | L9Ab16 | US20150158934 SEQ ID NO: 148 | 8638 |
| HIV1020 | Heavy chain variable region | L9Ab19 | US20150158934 SEQ ID NO: 149 | 8639 |
| HIV1021 | Heavy chain variable region | L9Ad13 | US20150158934 SEQ ID NO: 151 | 8640 |
| HIV1022 | Heavy chain variable region | L9Ad14 | US20150158934 SEQ ID NO: 152 | 8641 |
| HIV1023 | Heavy chain variable region | L9Ad3 | US20150158934 SEQ ID NO: 150 | 8642 |
| HIV1024 | Heavy chain variable region | L9Aj2 | US20150158934 SEQ ID NO: 153 | 8643 |
| HIV1025 | Heavy chain variable region | L9An7 | US20150158934 SEQ ID NO: 154 | 8644 |
| HIV1026 | Heavy chain variable region | L9Ao15 | US20150158934 SEQ ID NO: 155 | 8645 |
| HIV1027 | Heavy chain variable region | L9Ap11 | US20150158934 SEQ ID NO: 156 | 8646 |

TABLE 42-continued

HIV Antibodies

| Antibody No. | Description | Antibody Name | Reference Information | SEQ ID NO |
|---|---|---|---|---|
| HIV1028 | Heavy chain variable region | L9Bb3 | US20150158934 SEQ ID NO: 157 | 8647 |
| HIV1029 | Heavy chain variable region | L9Bc6 | US20150158934 SEQ ID NO: 158 | 8648 |
| HIV1030 | Heavy chain variable region | L9Bd8 | US20150158934 SEQ ID NO: 159 | 8649 |
| HIV1031 | Heavy chain variable region | L9Bd9 | US20150158934 SEQ ID NO: 160 | 8650 |
| HIV1032 | Heavy chain variable region | L9Be11 | US20150158934 SEQ ID NO: 161 | 8651 |
| HIV1033 | Heavy chain variable region | L9Bf11 | US20150158934 SEQ ID NO: 49 | 8652 |
| HIV1034 | Heavy chain variable region | L9Bf19 | US20150158934 SEQ ID NO: 162 | 8653 |
| HIV1035 | Heavy chain variable region | L9Bj13 | US20150158934 SEQ ID NO: 163 | 8654 |
| HIV1036 | Heavy chain variable region | L9Bm10 | US20150158934 SEQ ID NO: 164 | 8655 |
| HIV1037 | Heavy chain variable region | L9Bm16 | US20150158934 SEQ ID NO: 56 | 8656 |
| HIV1038 | Heavy chain variable region | L9Bp16 | US20150158934 SEQ ID NO: 165 | 8657 |
| HIV1039 | Heavy chain variable region | L9Bp5 | US20150158934 SEQ ID NO: 44 | 8658 |
| HIV1040 | Heavy chain variable region | L9Ca12 | US20150158934 SEQ ID NO: 166 | 8659 |
| HIV1041 | Heavy chain variable region | L9Ca13 | US20150158934 SEQ ID NO: 167 | 8660 |
| HIV1042 | Heavy chain variable region | L9Cd12 | US20150158934 SEQ ID NO: 168 | 8661 |
| HIV1043 | Heavy chain variable region | L9Cf15 | US20150158934 SEQ ID NO: 169 | 8662 |
| HIV1044 | Heavy chain variable region | L9Cl22 | US20150158934 SEQ ID NO: 52 | 8663 |
| HIV1045 | Heavy chain variable region | L9Cm18 | US20150158934 SEQ ID NO: 170 | 8664 |
| HIV1046 | Heavy chain variable region | L9Co22 | US20150158934 SEQ ID NO: 171 | 8665 |
| HIV1047 | Heavy chain variable region | L9Cp5 | US20150158934 SEQ ID NO: 172 | 8666 |
| HIV1048 | Heavy chain variable region | L9Cpl3 | US20150158934 SEQ ID NO: 173 | 8667 |
| HIV1049 | Heavy chain variable region | Makandal monoclonal antibody (Mmab) | US20100111990 SEQ ID NO: 4 | 8668 |
| HIV1050 | Heavy chain variable region | NM-01 | U.S. Pat. No. 5,665,569 SEQ ID NO: 17 | 8669 |
| HIV1051 | Heavy chain variable region | NM-01 HuVH | U.S. Pat. No. 5,665,569 SEQ ID NO: 27 | 8670 |
| HIV1052 | Heavy chain variable region | NM-01 HuVK | U.S. Pat. No. 5,665,569 SEQ ID NO: 29 | 8671 |
| HIV1053 | Heavy chain variable region | NM-01 HuVKF | U.S. Pat. No. 5,665,569 SEQ ID NO: 31 | 8672 |
| HIV1054 | Heavy chain variable region | PGT125 | Walker L. M. et al "Broad neutralization coverage of HIV by multiple highly potent antibodies", Nature 477 (7365), 466-470 (2011), NCBI Accession # AEN14393 | 8673 |
| HIV1055 | Heavy chain variable region | PGT126 | Walker L. M. et al "Broad neutralization coverage of HIV by multiple highly potent antibodies", Nature 477 (7365), 466-470 (2011), NCBI Accession # AEN14394 | 8674 |
| HIV1056 | Heavy chain variable region | PGT131 | Walker L. M. et al "Broad neutralization coverage of HIV by multiple highly potent antibodies", Nature 477 (7365), 466-470 (2011), NCBI Accession # AEN14389 | 8675 |
| HIV1057 | Heavy chain variable region | PGT136 | Walker L. M. et al "Broad neutralization coverage of HIV by multiple highly potent antibodies", Nature 477 (7365), 466-470 (2011), NCBI Accession # AEN14400 | 8676 |
| HIV1058 | Heavy chain variable region | PGT137 | Walker L. M. et al "Broad neutralization coverage of HIV by multiple highly potent antibodies", Nature 477 (7365), 466-470 (2011), NCBI Accession # AEN14401 | 8677 |

TABLE 42-continued

HIV Antibodies

| Antibody No. | Description | Antibody Name | Reference Information | SEQ ID NO |
|---|---|---|---|---|
| HIV1059 | Heavy chain variable region | PGT141 | Walker L. M. et al "Broad neutralization coverage of HIV by multiple highly potent antibodies", Nature 477 (7365), 466-470 (2011), NCBI Accession # AEN14402 | 8678 |
| HIV1060 | Heavy chain variable region | PGT142 | Walker L. M. et al "Broad neutralization coverage of HIV by multiple highly potent antibodies", Nature 477 (7365), 466-470 (2011), NCBI Accession # AEN14368 | 8679 |
| HIV1061 | Heavy chain variable region | PGT143 | Walker L. M. et al "Broad neutralization coverage of HIV by multiple highly potent antibodies", Nature 477 (7365), 466-470 (2011), NCBI Accession # AEN14404 | 8680 |
| HIV1062 | Heavy chain variable region | PGT144 | Walker L. M. et al "Broad neutralization coverage of HIV by multiple highly potent antibodies", Nature 477 (7365), 466-470 (2011), NCBI Accession # AEN14405 | 8681 |
| HIV1063 | Heavy chain variable region | PGT151 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC3535 | 8682 |
| HIV1064 | Heavy chain variable region | PGT152 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32536 | 8683 |
| HIV1065 | Heavy chain variable region | PGT153 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32537 | 8684 |
| HIV1066 | Heavy chain variable region | PGT154 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32521 | 8685 |
| HIV1067 | Heavy chain variable region | PGT155 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32539 | 8686 |
| HIV1068 | Heavy chain variable region | PGT156 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32540 | 8687 |
| HIV1069 | Heavy chain variable region | PGT157 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32541 | 8688 |
| HIV1070 | Heavy chain variable region | PGT158 | Falkowska, E. et al "Broadly Neutralizing HIV Antibodies Define a Glycan-Dependent Epitope on the Perfusion Conformation of gp41 on Cleaved Envelope Trimers" Immunity 40 (5), 657-668 (2014), NCBI Accession # AIC32542 | 8689 |
| HIV1071 | Heavy chain variable region | rF105 | WO1993012232 SEQ ID NO: 4 | 8690 |
| HIV1072 | Heavy chain variable region | ScFvX5-CD4 | U.S. Pat. No. 7,378,093B2 SEQ ID NO: 14 | 8691 |
| HIV1073 | Heavy chain variable region | TNX-355, Idalizumab | US20130195881 SEQ ID NO: 3 | 8692 |
| HIV1074 | Heavy chain variable region | VCR14 | US20150044137 SEQ ID NO: 13 | 8693 |
| HIV1075 | Heavy chain variable region | VCR14b | US20150044137 SEQ ID NO: 14 | 8694 |
| HIV1076 | Heavy chain variable region | VCR14c | US20150044137 SEQ ID NO: 15 | 8695 |
| HIV1077 | Heavy chain variable region | VCR16 | US20150044137 SEQ ID NO: 29 | 8696 |
| HIV1078 | Heavy chain variable region | VCR16b | US20150044137 SEQ ID NO: 30 | 8697 |
| HIV1079 | Heavy chain variable region | VCR16c | US20150044137 SEQ ID NO: 31 | 8698 |

TABLE 42-continued

HIV Antibodies

| Antibody No. | Description | Antibody Name | Reference Information | SEQ ID NO |
|---|---|---|---|---|
| HIV1080 | Heavy chain variable region | VCR16d | US20150044137 SEQ ID NO: 32 | 8699 |
| HIV1081 | Heavy chain variable region | VLP_A14 | US20150158934 SEQ ID NO: 203 | 8700 |
| HIV1082 | Heavy chain variable region | VLP_B9 | US20150158934 SEQ ID NO: 204 | 8701 |
| HIV1083 | Heavy chain variable region | VLP3_B21 | US20150158934 SEQ ID NO: 205 | 8702 |
| HIV1084 | Heavy chain variable region | VRC13 | US20150044137 SEQ ID NO: 5 | 8703 |
| HIV1085 | Heavy chain variable region | VRC13b | US20150044137 SEQ ID NO: 6 | 8704 |
| HIV1086 | Heavy chain variable region | VRC13c | US20150044137 SEQ ID NO: 7 | 8705 |
| HIV1087 | Heavy chain variable region | VRC13d | US20150044137 SEQ ID NO: 8 | 8706 |
| HIV1088 | Heavy chain variable region | VRC13e | US20150044137 SEQ ID NO: 9 | 8707 |
| HIV1089 | Heavy chain variable region | VRC13f | US20150044137 SEQ ID NO: 10 | 8708 |
| HIV1090 | Heavy chain variable region | VRC13g | US20150044137 SEQ ID NO: 11 | 8709 |
| HIV1091 | Heavy chain variable region | VRC13h | US20150044137 SEQ ID NO: 12 | 8710 |
| HIV1092 | Heavy chain variable region | VRC15 | US20150044137 SEQ ID NO: 16 | 8711 |
| HIV1093 | Heavy chain variable region | | US20150004190 SEQ ID NO: 56 | 8712 |
| HIV1094 | Heavy chain variable region, partial | P7 | NCBI Accession # AAB41043.1 (136aa) | 8713 |
| HIV1095 | Heavy Chain, Fab | Ch04 | McLellan, J. S. et al., Structure of HIV-1 gp120 V1 V2 domain with broadly neutralizing antibody PG9; Nature 480 (7377), 336-343 (2011), NCBI Accession # 3TCL_A (237aa) | 8714 |
| HIV1096 | Heavy Chain, Fab | N5-i5 | Acharya, P., et al., Structural Definition of an Antibody-Dependent Cellular Cytotoxicity Response Implicated in Reduced Risk for HIV-1 infection; J. Virol. 88 (21), 12895-12906 (2014), NCBI Accession # 4H8W_H (226aa) | 8715 |
| HIV1097 | Heavy Chain, Fab | N60-i3 | Gohain, N., et al., Cocrystal Structures of Antibody N60-i3 and Antibody JR4 in Complex with gp120 Define More Cluster A Epitopes Involved in Effective Antibody-Dependent Effector Function against HIV-1; J. Virol. 89 (17), 8840-8854 (2015), NCBI Accession # 4RFO_H (229aa) | 8716 |
| HIV1098 | Heavy Chain, Ig Gamma-1 Chain C Region | Nih45-46 Fab | Diskin, R., et al., Science 334 (6060), 1289-1293 (2011), NCBI Accession # 3U7Y_H (229aa) | 8717 |
| HIV1099 | Heavy Chain, Ig Gamma-1 Chain C Region | Pgt127 | Pejchal, R., et al., Science 334 (6059), 1097-1103 (2011), NCBI Accession # 3TWC_H(239aa) | 8718 |
| HIV1100 | Heavy Chain, Ig Gamma-1 Chain C Region | Pgt128 | Pejchal, R., et al., Science 334 (6059), 1097-1103 (2011), NCBI Accession # 3TV3_H(239aa) | 8719 |
| HIV1101 | HIV, heavy chain | Suvizumab | | 8720 |
| HIV1102 | HIV1 gp120 antibody, heavy chain | HIV1 gp120 antibody | WO2001000678 SEQ ID NO: 43 | 8721 |
| HIV1103 | HIV1 gp120 antibody, heavy chain | HIV1 gp120 antibody | WO2001000678 SEQ ID NO: 44 | 8722 |
| HIV1104 | HIV1 gp120 antibody, heavy chain | HIV1 gp120 antibody | WO2001000678 SEQ ID NO: 45 | 8723 |
| HIV1105 | HIV1 gp120 antibody, heavy chain | HIV1 gp120 antibody | WO2001000678 SEQ ID NO: 46 | 8724 |
| HIV1106 | HIV1 gp120 antibody, heavy chain | HIV1 gp120 antibody | WO2001000678 SEQ ID NO: 47 | 8725 |
| HIV1107 | HIV1 gp120 antibody, heavy chain | HIV1 gp120 antibody | WO2001000678 SEQ ID NO: 48 | 8726 |
| HIV1108 | HIV1 gp120 antibody, heavy chain | HIV1 gp120 antibody | WO2001000678 SEQ ID NO: 49 | 8727 |
| HIV1109 | HIV1 gp120 antibody, heavy chain | HIV1 gp120 antibody | WO2001000678 SEQ ID NO: 57 | 8728 |
| HIV1110 | HIV1 gp120 antibody, heavy chain | HIV1 gp120 antibody | WO2001000678 SEQ ID NO: 58 | 8729 |

TABLE 42-continued

HIV Antibodies

| Antibody No. | Description | Antibody Name | Reference Information | SEQ ID NO |
|---|---|---|---|---|
| HIV1111 | HIV1 gp120 antibody, heavy chain | HIV1 gp120 antibody | WO2001000678 SEQ ID NO: 59 | 8730 |
| HIV1112 | HIV1 gp120 antibody, heavy chain | HIV1 gp120 antibody | WO2001000678 SEQ ID NO: 60 | 8731 |
| HIV1113 | HIV1 gp120 antibody, heavy chain | HIV1 gp120 antibody | WO2001000678 SEQ ID NO: 61 | 8732 |
| HIV1114 | HIV1 gp120 antibody, heavy chain | HIV1 gp120 antibody | WO2001000678 SEQ ID NO: 62 | 8733 |
| HIV1115 | HIV1 gp120 antibody, heavy chain | HIV1 gp120 antibody | WO2001000678 SEQ ID NO: 63 | 8734 |
| HIV1116 | HIV1 gp120 antibody, heavy chain | HIV1 gp120 antibody | WO2001000678 SEQ ID NO: 64 | 8735 |
| HIV1117 | HIV1 gp120 antibody, heavy chain | HIV1 gp120 antibody | WO2001000678 SEQ ID NO: 73 | 8736 |
| HIV1118 | HIV1 gp120 antibody, heavy chain | HIV1 gp120 antibody | WO2001000678 SEQ ID NO: 74 | 8737 |
| HIV1119 | HIV1 gp120 antibody, heavy chain | HIV1 gp120 antibody | WO2001000678 SEQ ID NO: 75 | 8738 |
| HIV1120 | HIV1 gp120 antibody, heavy chain | HIV1 gp120 antibody | WO2001000678 SEQ ID NO: 76 | 8739 |
| HIV1121 | HIV1 gp120 antibody, heavy chain | HIV1 gp120 antibody | WO2001000678 SEQ ID NO: 77 | 8740 |
| HIV1122 | HIV1 gp120 antibody, heavy chain | HIV1 gp120 antibody | WO2001000678 SEQ ID NO: 78 | 8741 |
| HIV1123 | HIV1 gp120 antibody, light chain | HIV1 gp120 antibody | WO2001000678 SEQ ID NO: 50 | 8742 |
| HIV1124 | HIV1 gp120 antibody, light chain | HIV1 gp120 antibody | WO2001000678 SEQ ID NO: 51 | 8743 |
| HIV1125 | HIV1 gp120 antibody, light chain | HIV1 gp120 antibody | WO2001000678 SEQ ID NO: 52 | 8744 |
| HIV1126 | HIV1 gp120 antibody, light chain | HIV1 gp120 antibody | WO2001000678 SEQ ID NO: 53 | 8745 |
| HIV1127 | HIV1 gp120 antibody, light chain | HIV1 gp120 antibody | WO2001000678 SEQ ID NO: 54 | 8746 |
| HIV1128 | HIV1 gp120 antibody, light chain | HIV1 gp120 antibody | WO2001000678 SEQ ID NO: 55 | 8747 |
| HIV1129 | HIV1 gp120 antibody, light chain | HIV1 gp120 antibody | WO2001000678 SEQ ID NO: 56 | 8748 |
| HIV1130 | HIV1 gp120 antibody, light chain | HIV1 gp120 antibody | WO2001000678 SEQ ID NO: 65 | 8749 |
| HIV1131 | HIV1 gp120 antibody, light chain | HIV1 gp120 antibody | WO2001000678 SEQ ID NO: 66 | 8750 |
| HIV1132 | HIV1 gp120 antibody, light chain | HIV1 gp120 antibody | WO2001000678 SEQ ID NO: 67 | 8751 |
| HIV1133 | HIV1 gp120 antibody, light chain | HIV1 gp120 antibody | WO2001000678 SEQ ID NO: 68 | 8752 |
| HIV1134 | HIV1 gp120 antibody, light chain | HIV1 gp120 antibody | WO2001000678 SEQ ID NO: 69 | 8753 |
| HIV1135 | HIV1 gp120 antibody, light chain | HIV1 gp120 antibody | WO2001000678 SEQ ID NO: 70 | 8754 |
| HIV1136 | HIV1 gp120 antibody, light chain | HIV1 gp120 antibody | WO2001000678 SEQ ID NO: 71 | 8755 |
| HIV1137 | HIV1 gp120 antibody, light chain | HIV1 gp120 antibody | WO2001000678 SEQ ID NO: 72 | 8756 |
| HIV1138 | HIV1 gp120 antibody, light chain | HIV1 gp120 antibody | WO2001000678 SEQ ID NO: 79 | 8757 |
| HIV1139 | HIV1 gp120 antibody, light chain | HIV1 gp120 antibody | WO2001000678 SEQ ID NO: 80 | 8758 |
| HIV1140 | HIV1 gp120 antibody, light chain | HIV1 gp120 antibody | WO2001000678 SEQ ID NO: 81 | 8759 |
| HIV1141 | HIV1 gp120 antibody, light chain | HIV1 gp120 antibody | WO2001000678 SEQ ID NO: 82 | 8760 |
| HIV1142 | HIV1 gp120 antibody, light chain | HIV1 gp120 antibody | WO2001000678 SEQ ID NO: 83 | 8761 |
| HIV1143 | Kappa light chain | 1460_G14 | U.S. Pat. No. 9,051,362 SEQ ID NO: 22 | 8762 |
| HIV1144 | Kappa light chain variable region | 1456_P20 | U.S. Pat. No. 9,051,362 SEQ ID NO: 34 | 8763 |
| HIV1145 | Kappa light chain variable region | 1460_G14 | U.S. Pat. No. 9,051,362 SEQ ID NO: 36 | 8764 |
| HIV1146 | Kappa light chain | 1456_P20 | U.S. Pat. No. 9,051,362 SEQ ID NO: 18 | 8765 |
| HIV1147 | Lambda light chain | 1456_A12 | U.S. Pat. No. 9,051,362 SEQ ID NO: 50 | 8766 |
| HIV1148 | Lambda light chain | 1469_M23 | U.S. Pat. No. 9,051,362 SEQ ID NO: 142 | 8767 |
| HIV1149 | Lambda light chain | 1489_I13 | U.S. Pat. No. 9,051,362 SEQ ID NO: 14 | 8768 |
| HIV1150 | Lambda light chain | 1495_C14 | U.S. Pat. No. 9,051,362 SEQ ID NO: 26 | 8769 |

TABLE 42-continued

HIV Antibodies

| Antibody No. | Description | Antibody Name | Reference Information | SEQ ID NO |
|---|---|---|---|---|
| HIV1151 | Lambda light chain variable region | 1489_I13 | U.S. Pat. No. 9,051,362 SEQ ID NO: 32 | 8770 |
| HIV1152 | Lambda light chain variable region | 1495_C14 | U.S. Pat. No. 9,051,362 SEQ ID NO: 38 | 8771 |
| HIV1153 | Lambda light chain variable region | 1496_C09 | U.S. Pat. No. 9,051,362 SEQ ID NO: 40 | 8772 |
| HIV1154 | Lambda light chain variable region | 1456_A12 | U.S. Pat. No. 9,051,362 SEQ ID NO: 51 | 8773 |
| HIV1155 | Lambda light chain variable region | 1503_H05 | U.S. Pat. No. 9,051,362 SEQ ID NO: 56 | 8774 |
| HIV1156 | Lambda light chain | 1496_C09 | U.S. Pat. No. 9,051,362 SEQ ID NO: 30 | 8775 |
| HIV1157 | Light chain | 2424 | Kumar, R., et al., Functional and Structural Characterization of Human V3-Specific Monoclonal Antibody 2424 with Neutralizing Activity against HIV-1 JRFL; J. Virol. 89 (17), 9090-9102 (2015), NCBI Accession # 4XML_L(215aa) | 8776 |
| HIV1158 | Light chain | 8062 | Gustchina, E., PLoS ONE 8 (11), E78187 (2013), NCBI Accession # 4KHX_L(213aa) | 8777 |
| HIV1159 | Light chain | 1.00E+09 | US20140348785 SEQ ID NO: 2 | 8778 |
| HIV1160 | Light Chain | 10e8 (monoclonal) | Huang J et al., Nature 491 (7424), 406-412 (2012), NCBI Accession # 4G6F_D (215aa) | 8779 |
| HIV1161 | Light chain | 12a12kc | US20140328862 SEQ ID NO: 453 | 8780 |
| HIV1162 | Light chain | 12a13kc | US20140328862 SEQ ID NO: 454 | 8781 |
| HIV1163 | Light chain | 12a16kc | US20140328862 SEQ ID NO: 455 | 8782 |
| HIV1164 | Light chain | 12a1kc | US20140328862 SEQ ID NO: 456 | 8783 |
| HIV1165 | Light chain | 12a20kc | US20140328862 SEQ ID NO: 457 | 8784 |
| HIV1166 | Light chain | 12a21 | NCBI Accession # 4JPW_L (210aa) | 8785 |
| HIV1167 | Light chain | 12a21kc | US20140328862 SEQ ID NO: 458 | 8786 |
| HIV1168 | Light chain | 12a22kc | US20140328862 SEQ ID NO: 459 | 8787 |
| HIV1169 | Light chain | 12a23kc | US20140328862 SEQ ID NO: 460 | 8788 |
| HIV1170 | Light chain | 12a27kc | US20140328862 SEQ ID NO: 461 | 8789 |
| HIV1171 | Light chain | 12a46kc | US20140328862 SEQ ID NO: 462 | 8790 |
| HIV1172 | Light chain | 12a55kc | US20140328862 SEQ ID NO: 463 | 8791 |
| HIV1173 | Light chain | 12a56kc | US20140328862 SEQ ID NO: 464 | 8792 |
| HIV1174 | Light chain | 12a6kc | US20140328862 SEQ ID NO: 465 | 8793 |
| HIV1175 | Light chain | 12a7kc | US20140328862 SEQ ID NO: 466 | 8794 |
| HIV1176 | Light chain | 17b | Kwong, P. D., et al., structure of an HIV gp120 envelope glycoprotein in complex with the CD4 receptor and a neutralizing human antibody; Nature 393 (6686). 648-659 (1998), NCBI Accession # 1G9M_L(214aa) | 8795 |
| HIV1177 | Light chain | 1b2530 | Zhou T et al., Structural Repertoire of HIV-1-Neutralizing Antibodies Targeting the CD4 Supersite in 14 Donors; Cell 161 (6), 1280-1292 (2015), NCBI Accession # 4YFL_L (215aa) | 8796 |
| HIV1178 | Light chain | 1F7 | U.S. Pat. No. 6,057,421A FIG. 8 | 8797 |
| HIV1179 | Light chain | 1NC9 | WO2012154312 SEQ ID NO: 2472 | 8798 |
| HIV1180 | Light chain | 2.2C | Acharya, P., et al., Structural Definition of an Antibody-Dependent Cellular Cytotoxicity Response Implicated in Reduced Risk for HIV-1 Infection; J. Virol. 88 (21), 12895-12906 (2014), NCBI Accession # 4R4N_L (210aa) | 8799 |
| HIV1181 | Light chain | 2F5 | U.S. Pat. No. 8,637,036B2 SEQ ID NO: 10 | 8800 |
| HIV1182 | Light chain | 3040LC | WO2015117008 SEQ ID NO: 29 | 8801 |
| HIV1183 | Light chain | 3044LC | WO2015117008 SEQ ID NO: 32 | 8802 |
| HIV1184 | Light chain | 3430LC | WO2015117008 SEQ ID NO: 30 | 8803 |
| HIV1185 | Light chain | 3484LC | WO2015117008 SEQ ID NO: 31 | 8804 |
| HIV1186 | Light chain | 3630LC | WO2015117008 SEQ ID NO: 33 | 8805 |
| HIV1187 | Light chain | 3A124KC | US20140328862 SEQ ID NO: 506 | 8806 |
| HIV1188 | Light chain | 3A125KC | US20140328862 SEQ ID NO: 507 | 8807 |
| HIV1189 | Light chain | 3A140LC | US20140328862 SEQ ID NO: 508 | 8808 |
| HIV1190 | Light chain | 3A144KC | US20140328862 SEQ ID NO: 509 | 8809 |
| HIV1191 | Light chain | 3A160KC | US20140328862 SEQ ID NO: 510 | 8810 |
| HIV1192 | Light chain | 3A18KC | US20140328862 SEQ ID NO: 511 | 8811 |
| HIV1193 | Light chain | 3A204KC | US20140328862 SEQ ID NO: 512 | 8812 |
| HIV1194 | Light chain | 3A228KC | US20140328862 SEQ ID NO: 513 | 8813 |
| HIV1195 | Light chain | 3A233LC | US20140328862 SEQ ID NO: 514 | 8814 |
| HIV1196 | Light chain | 3A244LC | US20140328862 SEQ ID NO: 515 | 8815 |
| HIV1197 | Light chain | 3A255LC | US20140328862 SEQ ID NO: 516 | 8816 |
| HIV1198 | Light chain | 3A296KC | US20140328862 SEQ ID NO: 517 | 8817 |
| HIV1199 | Light chain | 3A334LC | US20140328862 SEQ ID NO: 518 | 8818 |
| HIV1200 | Light chain | 3A366KC | US20140328862 SEQ ID NO: 519 | 8819 |

TABLE 42-continued

HIV Antibodies

| Antibody No. | Description | Antibody Name | Reference Information | SEQ ID NO |
|---|---|---|---|---|
| HIV1201 | Light chain | 3A384KC | US20140328862 SEQ ID NO: 520 | 8820 |
| HIV1202 | Light chain | 3A419KC | US20140328862 SEQ ID NO: 521 | 8821 |
| HIV1203 | Light chain | 3a426kc | US20140328862 SEQ ID NO: 535 | 8822 |
| HIV1204 | Light chain | 3A461KC | US20140328862 SEQ ID NO: 522 | 8823 |
| HIV1205 | Light chain | 3A474KC | US20140328862 SEQ ID NO: 523 | 8824 |
| HIV1206 | Light chain | 3a515kc | US20140328862 SEQ ID NO: 536 | 8825 |
| HIV1207 | Light chain | 3A518KC | US20140328862 SEQ ID NO: 524 | 8826 |
| HIV1208 | Light chain | 3A539LC | US20140328862 SEQ ID NO: 525 | 8827 |
| HIV1209 | Light chain | 3A576LC | US20140328862 SEQ ID NO: 526 | 8828 |
| HIV1210 | Light chain | 3A613LC | US20140328862 SEQ ID NO: 527 | 8829 |
| HIV1211 | Light chain | 3A64KC | US20140328862 SEQ ID NO: 528 | 8830 |
| HIV1212 | Light chain | 3A650KC | US20140328862 SEQ ID NO: 529 | 8831 |
| HIV1213 | Light chain | 3A67KC | US20140328862 SEQ ID NO: 530 | 8832 |
| HIV1214 | Light chain | 3A779KC | US20140328862 SEQ ID NO: 531 | 8833 |
| HIV1215 | Light chain | 3A816KC | US20140328862 SEQ ID NO: 532 | 8834 |
| HIV1216 | Light chain | 3A869KC | US20140328862 SEQ ID NO: 533 | 8835 |
| HIV1217 | Light chain | 3A93LC | US20140328862 SEQ ID NO: 534 | 8836 |
| HIV1218 | Light chain | 3anc3kc | US20140328862 SEQ ID NO: 547 | 8837 |
| HIV1219 | Light chain | 3b106kc | US20140328862 SEQ ID NO: 548 | 8838 |
| HIV1220 | Light chain | 3b129kc | US20140328862 SEQ ID NO: 537 | 8839 |
| HIV1221 | Light chain | 3b16kc | US20140328862 SEQ ID NO: 549 | 8840 |
| HIV1222 | Light chain | 3b171lc | US20140328862 SEQ ID NO: 538 | 8841 |
| HIV1223 | Light chain | 3b180kc | US20140328862 SEQ ID NO: 550 | 8842 |
| HIV1224 | Light chain | 3b183kc | US20140328862 SEQ ID NO: 551 | 8843 |
| HIV1225 | Light chain | 3b191kc | US20140328862 SEQ ID NO: 552 | 8844 |
| HIV1226 | Light chain | 3b21kc | US20140328862 SEQ ID NO: 553 | 8845 |
| HIV1227 | Light chain | 3b27kc | US20140328862 SEQ ID NO: 539 | 8846 |
| HIV1228 | Light chain | 3b41kc | US20140328862 SEQ ID NO: 540 | 8847 |
| HIV1229 | Light chain | 3b46kc | US20140328862 SEQ ID NO: 542 | 8848 |
| HIV1230 | Light chain | 3b57lc | US20140328862 SEQ ID NO: 543 | 8849 |
| HIV1231 | Light chain | 3b5kc | US20140328862 SEQ ID NO: 541 | 8850 |
| HIV1232 | Light chain | 3b8kc | US20140328862 SEQ ID NO: 544 | 8851 |
| HIV1233 | Light chain | 3bnc102kc | US20140328862 SEQ ID NO: 554 | 8852 |
| HIV1234 | Light chain | 3bnc104kc | US20140328862 SEQ ID NO: 555 | 8853 |
| HIV1235 | Light chain | 3bnc105kc | US20140328862 SEQ ID NO: 556 | 8854 |
| HIV1236 | Light chain | 3bnc107kc | US20140328862 SEQ ID NO: 557 | 8855 |
| HIV1237 | Light chain | 3bnc108kc | US20140328862 SEQ ID NO: 558 | 8856 |
| HIV1238 | Light chain | 3bnc117 | Zhou T et al., Immunity 39 (2), 245-258 (2013), NCBI Accession # 4LSV_L(206aa) | 8857 |
| HIV1239 | Light chain | 3bnc117kc | US20140328862 SEQ ID NO: 559 | 8858 |
| HIV1240 | Light chain | 3bnc134kc | US20140328862 SEQ ID NO: 560 | 8859 |
| HIV1241 | Light chain | 3bnc142kc | US20140328862 SEQ ID NO: 561 | 8860 |
| HIV1242 | Light chain | 3bnc151kc | US20140328862 SEQ ID NO: 562 | 8861 |
| HIV1243 | Light chain | 3bnc153kc | US20140328862 SEQ ID NO: 563 | 8862 |
| HIV1244 | Light chain | 3bnc156kc | US20140328862 SEQ ID NO: 564 | 8863 |
| HIV1245 | Light chain | 3bnc158kc | US20140328862 SEQ ID NO: 565 | 8864 |
| HIV1246 | Light chain | 3bnc159kc | US20140328862 SEQ ID NO: 566 | 8865 |
| HIV1247 | Light chain | 3bnc15kc | US20140328862 SEQ ID NO: 567 | 8866 |
| HIV1248 | Light chain | 3bnc176kc | US20140328862 SEQ ID NO: 568 | 8867 |
| HIV1249 | Light chain | 3bnc193kc | US20140328862 SEQ ID NO: 569 | 8868 |
| HIV1250 | Light chain | 3bnc196kc | US20140328862 SEQ ID NO: 570 | 8869 |
| HIV1251 | Light chain | 3bnc31kc | US20140328862 SEQ ID NO: 571 | 8870 |
| HIV1252 | Light chain | 3bnc42kc | US20140328862 SEQ ID NO: 572 | 8871 |
| HIV1253 | Light chain | 3bnc53kc | US20140328862 SEQ ID NO: 573 | 8872 |
| HIV1254 | Light chain | 3BNC55KC | US20140328862 SEQ ID NO: 545 | 8873 |
| HIV1255 | Light chain | 3BNC60KC | US20140328862 SEQ ID NO: 546 | 8874 |
| HIV1256 | Light chain | 3bnc62kc | US20140328862 SEQ ID NO: 574 | 8875 |
| HIV1257 | Light chain | 3bnc65kc | US20140328862 SEQ ID NO: 575 | 8876 |
| HIV1258 | Light chain | 3bnc66kc | US20140328862 SEQ ID NO: 576 | 8877 |
| HIV1259 | Light chain | 3bnc75kc | US20140328862 SEQ ID NO: 577 | 8878 |
| HIV1260 | Light chain | 3bnc79kc | US20140328862 SEQ ID NO: 578 | 8879 |
| HIV1261 | Light chain | 3bnc81kc | US20140328862 SEQ ID NO: 579 | 8880 |
| HIV1262 | Light chain | 3bnc84kc | US20140328862 SEQ ID NO: 580 | 8881 |
| HIV1263 | Light chain | 3bnc87kc | US20140328862 SEQ ID NO: 581 | 8882 |
| HIV1264 | Light chain | 3bnc89kc | US20140328862 SEQ ID NO: 582 | 8883 |
| HIV1265 | Light chain | 3bnc91kc | US20140328862 SEQ ID NO: 583 | 8884 |
| HIV1266 | Light chain | 3bnc95kc | US20140328862 SEQ ID NO: 584 | 8885 |
| HIV1267 | Light chain | 412d | Huang et al., Science 317 (5846), 1930-1934 (2007), NCBI Accession # 2QAD_G (214aa) | 8886 |
| HIV1268 | Light Chain | 44-vrc13.01 | Zhon T et al., Structural Repertoire of HIV-1-Neutralizing Antibodies Targeting the CD4 Supersite in 14 Donors; Cell 161 (6), 1280-1292 (2015), NCBI Accession # 4YDJ_B (206aa) | 8887 |

TABLE 42-continued

| Antibody No. | Description | Antibody Name | Reference Information | SEQ ID NO |
|---|---|---|---|---|
| HIV1269 | Light chain | 45-46m2 | Diskin, R., et al., Restricting HIV-1 pathways for escape using rationally designed anti-HIV-1 antibodies; J. Exp. Med. 210 (6), 1235-1249 (2013), NCBI Accession # 4JKP_L (210aa) | 8888 |
| HIV1270 | Light chain | 4835_F12 (PGT-124) | US20140205612 SEQ ID NO: 413 | 8889 |
| HIV1271 | Light chain | 4838_L06 (PGT-121) | US20140205612 SEQ ID NO: 148 | 8890 |
| HIV1272 | Light chain | 4858_P08 (PGT-123) | US20140205612 SEQ ID NO: 176 | 8891 |
| HIV1273 | Light chain | 4869-K15 (PGT-133) | US20140205612 SEQ ID NO: 428 | 8892 |
| HIV1274 | Light chain | 4873_E03 (PGT-121) | US20140205612 SEQ ID NO: 147 | 8893 |
| HIV1275 | Light chain | 4876_M06 (PGT-134) | US20140205612 SEQ ID NO: 439 | 8894 |
| HIV1276 | Light chain | 4877_D15 (PGT-122) | US20140205612 SEQ ID NO: 160 | 8895 |
| HIV1277 | Light chain | 4964_G22 (PGT-141), 4993_K13 (PGT-141), 4995_E20 (PGT-142) | US20140205612 SEQ ID NO: 284 | 8896 |
| HIV1278 | Light chain | 4970_K22 (PGT-144) | US20140205612 SEQ ID NO: 312 | 8897 |
| HIV1279 | Light chain | 4980_N08 (PGT-143) | US20140205612 SEQ ID NO: 301 | 8898 |
| HIV1280 | Light chain | 4995_P16 (PGT-145) | US20140205612 SEQ ID NO: 385 | 8899 |
| HIV1281 | Light chain | 4e10 Fv | Finton, K. A., et al., PLoS Pathol. 9 (9), E1003639 (2013), NCBI Accession # 4LLV_B (112aa) | 8900 |
| HIV1282 | Light chain | 5114_A19 (PGT-128) | US20140205612 SEQ ID NO: 392 | 8901 |
| HIV1283 | Light chain | 5120_N10 (PGT-139) | US20140205612 SEQ ID NO: 469 | 8902 |
| HIV1284 | Light chain | 5131_A17 (PGT-132) | US20140205612 SEQ ID NO: 488 | 8903 |
| HIV1285 | Light chain | 5136_H01 (PGT-131) | US20140205612 SEQ ID NO: 355 | 8904 |
| HIV1286 | Light chain | 5138_G07 (PGT-138) | US20140205612 SEQ ID NO: 483 | 8905 |
| HIV1287 | Light chain | 5141_B17 (PGT-126) | US20140205612 SEQ ID NO: 208 | 8906 |
| HIV1288 | Light chain | 5145_B14 (PGT-127) | US20140205612 SEQ ID NO: 329 | 8907 |
| HIV1289 | Light chain | 5147_N06 (PGT-130) | US20140205612 SEQ ID NO: 244 | 8908 |
| HIV1290 | Light chain | 5329_C19 (PGT-136), 5366_P21 (PGT-136) | US20140205612 SEQ ID NO: 257 | 8909 |
| HIV1291 | Light chain | 5343_B08 (PGT-135), 5344_E16 (PGT-135) | US20140205612 SEQ ID NO: 240 | 8910 |
| HIV1292 | Light chain | 5345_I01 (PGT-137) | US20140205612 SEQ ID NO: 396 | 8911 |
| HIV1293 | Light chain | 6808_B09 (PGT-156) | US20140205612 SEQ ID NO: 553 | 8912 |
| HIV1294 | Light chain | 6831_A21 (PGT-151) | US20140205612 SEQ ID NO: 482 | 8913 |
| HIV1295 | Light chain | 6843_G20 (PGT-154) | US20140205612 SEQ ID NO: 524 | 8914 |
| HIV1296 | Light chain | 6881_N05 (PGT-158). | US20140205612 SEQ ID NO: 578 | 8915 |
| HIV1297 | Light chain | 6889_I17 (PGT-152) | US20140205612 SEQ ID NO: 496 | 8916 |
| HIV1298 | Light chain | 6891_F06 (PGT-153) | US20140205612 SEQ ID NO: 510 | 8917 |
| HIV1299 | Light chain | 6892_C23 (PGT-157) | US20140205612 SEQ ID NO: 565 | 8918 |

TABLE 42-continued

| | | | HIV Antibodies | |
|---|---|---|---|---|
| Antibody No. | Description | Antibody Name | Reference Information | SEQ ID NO |
| HIV1300 | Light chain | 6892_D19 (PGT-155) | US20140205612 SEQ ID NO: 539 | 8919 |
| HIV1301 | Light chain | 7H6 | US20140348785 SEQ ID NO: 4 | 8920 |
| HIV1302 | Light chain | 7N16 | US20140348785 SEQ ID NO: 6 | 8921 |
| HIV1303 | Light chain | 8anc131 | Zhou T et al. Structural Repertoire of HIV-1-Neutralizing Antibodies Targeting the CD4 Supersite in 14 Donors; Cell 161 (6), 1280-1292 (2015), NCBI Accession # 4RWY_L (213aa) | 8922 |
| HIV1304 | Light chain | 8ANC131KC | US20140328862 SEQ ID NO: 440 | 8923 |
| HIV1305 | Light chain | 8anc134 | Zhou T et al, Structural Repertoire of HIV-1-Neutralizing Antibodies Targeting the CD4 Supersite in 14 Donors; Cell 161 (6), 1280-1292 (2015), NCBI Accession # 4RX4_L (213aa) | 8924 |
| HIV1306 | Light chain | 8ANC134KC | US20140328862 SEQ ID NO: 441 | 8925 |
| HIV1307 | Light chain | 8ANC13KC | US20140328862 SEQ ID NO: 442 | 8926 |
| HIV1308 | Light chain | 8ANC14KC | US20140328862 SEQ ID NO: 448 | 8927 |
| HIV1309 | Light chain | 8ANC16KC | US20140328862 SEQ ID NO: 449 | 8928 |
| HIV1310 | Light chain | 8anc182kc | US20140328862 SEQ ID NO: 446 | 8929 |
| HIV1311 | Light chain | 8anc192kc | US20140328862 SEQ ID NO: 447 | 8930 |
| HIV1312 | Light chain | 8ANC195KC | US20140328862 SEQ ID NO: 450 | 8931 |
| HIV1313 | Light chain | 8ANC24KC | US20140328862 SEQ ID NO: 451 | 8932 |
| HIV1314 | Light chain | 8ANC45KC | US20140328862 SEQ ID NO: 443 | 8933 |
| HIV1315 | Light chain | 8ANC50KC | US20140328862 SEQ ID NO: 444 | 8934 |
| HIV1316 | Light chain | 8ANC5KC | US20140328862 SEQ ID NO: 452 | 8935 |
| HIV1317 | Light chain | 8ANC88KC | US20140328862 SEQ ID NO: 445 | 8936 |
| HIV1318 | Light chain | Anti-HcG | Fotinou C. et al "Structure of an Fab fragment against a C-terminal peptide of hCG at 2.0 A resolution" J. Biol. Chem. 273 (35), 22515-22518 (1998); NCBI Accession # 1SBS_L | 8937 |
| HIV1319 | Light chain | B12 | Zhou T et al., Structural definition of a conserved neutralization epitope on HIV-1 gp120; Nature 445 (7129), 732-737 (2007), NCBI Accession # 2NY7_L (215aa) | 8938 |
| HIV1320 | Light Chain | C38-vrc16.01 | Zhou T et al., Structural Repertoire of HIV-1-Neutralizing Antibodies Targeting the CD4 Supersite in 14 Donors; Cell 161 (6), 1280-1292 (2015), NCBI Accession # 4YDK_L (214aa) | 8939 |
| HIV1321 | Light chain | C38-vrc18.02 | Zhou T et al., Structural Repertoire of HIV-1-Neutralizing Antibodies Targeting the CD4 Supersite in 14 Donors; Cell 161 (6), 1280-1292 (2015), NCBI Accession # 4YDL_L (211aa) | 8940 |
| HIV1322 | Light chain | CAP256-VRC26.01 | WO2015128846 SEQ ID NO: 14 | 8941 |
| HIV1323 | Light chain | CAP256-VRC26.02 | WO2015128846 SEQ ID NO: 18 | 8942 |
| HIV1324 | Light chain | CAP256-VRC26.03 | WO2015128846 SEQ ID NO: 22 | 8943 |
| HIV1325 | Light chain | CAP256-VRC26.04 | WO2015128846 SEQ ID NO: 26 | 8944 |
| HIV1326 | Light chain | CAP256-VRC26.05 | WO2015128846 SEQ ID NO: 30 | 8945 |
| HIV1327 | Light chain | CAP256-VRC26.06 | WO2015128846 SEQ ID NO: 34 | 8946 |
| HIV1328 | Light chain | CAP256-VRC26.07 | WO2015128846 SEQ ID NO: 38 | 8947 |
| HIV1329 | Light chain | CAP256-VRC26.08 | WO2015128846 SEQ ID NO: 42 | 8948 |
| HIV1330 | Light chain | CAP256-VRC26.09 | WO2015128846 SEQ ID NO: 46 | 8949 |
| HIV1331 | Light chain | CAP256-VRC26.10 | WO2015128846 SEQ ID NO: 50 | 8950 |
| HIV1332 | Light chain | CAP256-VRC26.11 | WO2015128846 SEQ ID NO: 54 | 8951 |
| HIV1333 | Light chain | CAP256-VRC26.12 | WO2015128846 SEQ ID NO: 58 | 8952 |
| HIV1334 | Light chain | CAP256-VRC26.25 | WO2015128846 SEQ ID NO: 171 | 8953 |
| HIV1335 | Light chain | CAP256-VRC26.26 | WO2015128846 SEQ ID NO: 179 | 8954 |

TABLE 42-continued

HIV Antibodies

| Antibody No. | Description | Antibody Name | Reference Information | SEQ ID NO |
|---|---|---|---|---|
| HIV1336 | Light chain | CAP256-VRC26.27 | WO2015128846 SEQ ID NO: 187 | 8955 |
| HIV1337 | Light chain | CAP256-VRC26-I1 | WO2015128846 SEQ ID NO: 6 | 8956 |
| HIV1338 | Light chain | CAP256-VRC26-I2 | WO2015128846 SEQ ID NO: 10 | 8957 |
| HIV1339 | Light chain | CAP256-VRC26-UCA. | WO2015128846 SEQ ID NO: 2 | 8958 |
| HIV1340 | Light chain | construct #2816, #2861 | WO2015013390 SEQ ID NO: 5 | 8959 |
| HIV1341 | Light chain | construct #2817, #2860 | WO2015013390 SEQ ID NO: 6 | 8960 |
| HIV1342 | Light chain | construct #2858, #2859, #2861 | WO2015013390 SEQ ID NO: 7 | 8961 |
| HIV1343 | Light chain | Fab 2219 | Stanfield, R. L., et al., J. Virol. 80 (12), 6093-6105 (2006), NCBI Accession # 2B0S_L (215aa) | 8962 |
| HIV1344 | Light chain | Fab 2g12 | Doores, K. J., et al., J. Virol. 84 (20), 10690-10699 (2010), NCBI Accession # 3OAU_L(212a) | 8963 |
| HIV1345 | Light chain | Fab 2g12 | Stanfield, R. L. et al., Crystal structure of the HIV neutralizing antibody 2G12, in complex with a bacterial oligosaccharide analog of mammalian oligomannose; Glycobiology 25 (4), 412-419 (2015), NCBI Accession # 4RBP_L (213aa) | 8964 |
| HIV1346 | Light chain | Fab F425-b4e8 | Bell et al., J. Mol. Biol. 375 (4), 969-978 (2008), NCBI Accession # 2QSC_L (215aa) | 8965 |
| HIV1347 | Light chain | G4D | US20130195881 SEQ ID NO: 39 | 8966 |
| HIV1348 | Light chain | G4H | US20130195881 SEQ ID NO: 38 | 8967 |
| HIV1349 | Light chain | gVRC-H5(d74)/VRC-PG04LC, gVRCOH12(D74)/VRC-PG04LC | WO2013090644 SEQ ID NO: 19 | 8968 |
| HIV1350 | Light chain | 12 (unbound) From Ch103 Lineage | Fera, D. et al., Affinity maturation in an HIV broadly neutralizing B-cell lineage through reorientation of variable domains; Proc. Natl. Acad. Sci. U.S.A. 111 (28), 10275-10280 (2014), NCBI Accession # 4QHN_B (213aa) | 8969 |
| HIV1351 | Light chain | IGLV3-19*01 | US20140348785 SEQ ID NO: 8 | 8970 |
| HIV1352 | Light chain | k3 | WO2015117008 SEQ ID NO: 19 | 8971 |
| HIV1353 | Light chain | k5 | WO2015117008 SEQ ID NO: 20 | 8972 |
| HIV1354 | Light chain | k53 | WO2015117008 SEQ ID NO: 24 | 8973 |
| HIV1355 | Light chain | k59 | WO2015117008 SEQ ID NO: 21 | 8974 |
| HIV1356 | Light chain | k61 | WO2015117008 SEQ ID NO: 25 | 8975 |
| HIV1357 | Light chain | k62 | WO2015117008 SEQ ID NO: 22 | 8976 |
| HIV1358 | Light chain | k81 | WO2015117008 SEQ ID NO: 28 | 8977 |
| HIV1359 | Light chain | kl 1 | WO2015117008 SEQ ID NO: 26 | 8978 |
| HIV1360 | Light chain | kl8 | WO2015117008 SEQ ID NO: 23 | 8979 |
| HIV1361 | Light chain | kl9 | WO2015117008 SEQ ID NO: 27 | 8980 |
| HIV1362 | Light chain | LSSB2066KC | US20140328862 SEQ ID NO: 501 | 8981 |
| HIV1363 | Light chain | LSSB2080KC | US20140328862 SEQ ID NO: 502 | 8982 |
| HIV1364 | Light chain | LSSB2133KC | US20140328862 SEQ ID NO: 503 | 8983 |
| HIV1365 | Light chain | LSSB2182KC | US20140328862 SEQ ID NO: 504 | 8984 |
| HIV1366 | Light chain | LSSB2339LC | US20140328862 SEQ ID NO: 467 | 8985 |
| HIV1367 | Light chain | LSSB2351LC | US20140328862 SEQ ID NO: 468 | 8986 |
| HIV1368 | Light chain | LSSB2364LC | US20140328862 SEQ ID NO: 469 | 8987 |
| HIV1369 | Light chain | LSSB2367LC | US20140328862 SEQ ID NO: 470 | 8988 |
| HIV1370 | Light chain | LSSB2490LC | US20140328862 SEQ ID NO: 471 | 8989 |
| HIV1371 | Light chain | LSSB2530LC | US20140328862 SEQ ID NO: 472 | 8990 |
| HIV1372 | Light chain | LSSB2554LC | US20140328862 SEQ ID NO: 473 | 8991 |
| HIV1373 | Light chain | LSSB2586LC | US20140328862 SEQ ID NO: 474 | 8992 |
| HIV1374 | Light chain | LSSB2612LC | US20140328862 SEQ ID NO: 475 | 8993 |
| HIV1375 | Light chain | LSSB2640LC | US20140328862 SEQ ID NO: 476 | 8994 |
| HIV1376 | Light chain | LSSB2644LC | US20140328862 SEQ ID NO: 477 | 8995 |
| HIV1377 | Light chain | LSSB2666LC | US20140328862 SEQ ID NO: 478 | 8996 |
| HIV1378 | Light chain | LSSB2680LC | US20140328862 SEQ ID NO: 479 | 8997 |
| HIV1379 | Light chain | LSSB2683LC | US20140328862 SEQ ID NO: 480 | 8998 |
| HIV1380 | Light chain | LSSB331KC | US20140328862 SEQ ID NO: 505 | 8999 |
| HIV1381 | Light chain | LSSB344LC | US20140328862 SEQ ID NO: 481 | 9000 |
| HIV1382 | Light chain | LSSNEC107LC | US20140328862 SEQ ID NO: 482 | 9001 |

TABLE 42-continued

HIV Antibodies

| Antibody No. | Description | Antibody Name | Reference Information | SEQ ID NO |
|---|---|---|---|---|
| HIV1383 | Light chain | LSSNEC108LC | US20140328862 SEQ ID NO: 483 | 9002 |
| HIV1384 | Light chain | LSSNEC117LC | US20140328862 SEQ ID NO: 484 | 9003 |
| HIV1385 | Light chain | LSSNEC118LC | US20140328862 SEQ ID NO: 485 | 9004 |
| HIV1386 | Light chain | LSSNEC122LC | US20140328862 SEQ ID NO: 486 | 9005 |
| HIV1387 | Light chain | LSSNEC24LC | US20140328862 SEQ ID NO: 487 | 9006 |
| HIV1388 | Light chain | LSSNEC2LC | US20140328862 SEQ ID NO: 488 | 9007 |
| HIV1389 | Light chain | LSSNEC33LC | US20140328862 SEQ ID NO: 489 | 9008 |
| HIV1390 | Light chain | LSSNEC46LC | US20140328862 SEQ ID NO: 490 | 9009 |
| HIV1391 | Light chain | LSSNEC48LC | US20140328862 SEQ ID NO: 491 | 9010 |
| HIV1392 | Light chain | LSSNEC52LC | US20140328862 SEQ ID NO: 492 | 9011 |
| HIV1393 | Light chain | LSSNEC56LC | US20140328862 SEQ ID NO: 493 | 9012 |
| HIV1394 | Light chain | LSSNEC60LC | US20140328862 SEQ ID NO: 494 | 9013 |
| HIV1395 | Light chain | LSSNEC70LC | US20140328862 SEQ ID NO: 495 | 9014 |
| HIV1396 | Light chain | LSSNEC72LC | US20140328862 SEQ ID NO: 496 | 9015 |
| HIV1397 | Light chain | LSSNEC7LC | US20140328862 SEQ ID NO: 497 | 9016 |
| HIV1398 | Light chain | LSSNEC89LC | US20140328862 SEQ ID NO: 498 | 9017 |
| HIV1399 | Light chain | LSSNEC94LC | US20140328862 SEQ ID NO: 499 | 9018 |
| HIV1400 | Light chain | LSSNEC9LC | US20140328862 SEQ ID NO: 500 | 9019 |
| HIV1401 | Light chain | m12-Fd-aa | U.S. Pat. No. 7,803,913B2 SEQ ID NO: 7 | 9020 |
| HIV1402 | Light chain | m14-Fd-aa | U.S. Pat. No. 7,803,913B2 SEQ ID NO: 5 | 9021 |
| HIV1403 | Light chain | m16-Fd-aa | U.S. Pat. No. 7,803,913B2 SEQ ID NO: 8 | 9022 |
| HIV1404 | Light chain | m18 Fd-aa | U.S. Pat. No. 7,803,913B2 SEQ ID NO: 6 | 9023 |
| HIV1405 | Light chain | M66 | Ofek, G., et al., Structural Basis for HIV-1 Neutralization by 2F5-Like Antibodies m66 and m66.6; J. Virol. 88 (5), 2426-2441 (2014), NCBI Accession # 4NRY_H (235aa) | 9024 |
| HIV1406 | Light chain | M66.6 | Ofek, G., et al., Structural Basis for HIV-1 Neutralization by 2F5-Like Antibodies m66 and m66.6; J. Virol. 88 (5), 2426-2441 (2014), NCBI Accession # 4NRZ_L (213aa) | 9025 |
| HIV1407 | Light Chain | Mab 2158 | Spurrier, B., et al., Functional Implications of the Binding Mode of a Human Conformation-Dependent V2 Monoclonal Antibody against HIV; J. Virol, 88 (8), 4100-4112 (2014), NCBI Accession # 4OAW_C (214aa) | 9026 |
| HIV1408 | Light chain | MV1 | US20130195881 SEQ ID NO: 40 | 9027 |
| HIV1409 | Light chain | Pg16 Fab | Pancera, M., et al., Nat. Struct. Mol. Biol. 20 (7), 804-813 (2013), NCBI Accession # 4DQO_L (216aa) | 9028 |
| HIV1410 | Light chain | Pg9 | Willis, J. R., et al., J. Clin. Invest. 125 (6), 2523-2531 (2015), NCBI Accession # 4YAQ_L (216aa) | 9029 |
| HIV1411 | Light chain | Pgt121-Gl Fab | Mouquet H et al., Complex-type N-glycan recognition by potent broadly neutralizing HIV antibodies; Proc Natl Acad Sci USA. 2012 Nov. 20; 109(47): E3268-77, NCBI Accession # 4FQQ_A (215aa) | 9030 |
| HIV1412 | Light chain | Pgt122 | Julien, J. P., et al., PLoS Pathol. 9 (5), E1003342 (2013)", NCBI Accession # 4JY5_L (211aa) | 9031 |
| HIV1413 | Light chain | Pgt123 | Julien, J. P., et al., PLoS Pathol. 9 (5), E1003342 (2013)", NCBI Accession # 4JY6_A (211aa) | 9032 |
| HIV1414 | Light chain | Pgt124 | Garces, F., et al., Structural Evolution of Glycan Recognition by a Family of Potent HIV Antibodies; Cell 159 (1), 69-79 (2014), NCBI Accession # 4R26_L (214aa) | 9033 |
| HIV1415 | Light chain | Pgt130 | Doores, K. J., et al., J. Virol. 89 (2), 1105-1118 (2015), NCBI Accession # 4RNR_B (216aa) | 9034 |
| HIV1416 | Light chain | Pgt135 | Grover et al., Science 343 (6171), 656-661 (2014), NCBI Accession # 4NZR_L (214aa) | 9035 |
| HIV1417 | Light chain | S8, S19, S20 | US20110059015 SEQ ID NO: 2 | 9036 |
| HIV1418 | light chain | Suvizumab | | 9037 |
| HIV1419 | Light Chain | Vrc-Pg04 | Wu, X., et al., Focused evolution of HIV-1 neutralizing antibodies revealed by structures and deep sequencing; Science 333 (6049), 1593-1602 (2011)", NCBI Accession # 3SE9_L (208aa) | 9038 |
| HIV1420 | Light chain | VRC01 | U.S. Pat. No. 8,637,036B2 SEQ ID NO: 2 | 9039 |
| HIV1421 | Light chain | VRC01 E1/12 deletion | US2014 0322163 SEQ ID NO: 53 | 9040 |

TABLE 42-continued

HIV Antibodies

| Antibody No. | Description | Antibody Name | Reference Information | SEQ ID NO |
|---|---|---|---|---|
| HIV1422 | Light chain | VRC01 E1/I2del F97D | US2014 0322163 SEQ ID NO: 222 | 9041 |
| HIV1423 | Light chain | VRC01 E1/I2del F97H | US2014 0322163 SEQ ID NO: 225 | 9042 |
| HIV1424 | Light chain | VRC01 E1/I2del F97K | US2014 0322163 SEQ ID NO: 223 | 9043 |
| HIV1425 | Light chain | VRC01 E1/I2del F97S | US2014 0322163 SEQ ID NO: 224 | 9044 |
| HIV1426 | Light chain | VRC01 E1/I2del V3E | US2014 0322163 SEQ ID NO: 219 | 9045 |
| HIV1427 | Light chain | VRC01 E1/I2del V3E, F97H | US2014 0322163 SEQ ID NO: 227 | 9046 |
| HIV1428 | Light chain | VRC01 E1/I2del V3E, F97S | US2014 0322163 SEQ ID NO: 226 | 9047 |
| HIV1429 | Light chain | VRC01 E1/I2del V3K | US2014 0322163 SEQ ID NO: 220 | 9048 |
| HIV1430 | Light chain | VRC01 E1/I2del V3S | US2014 0322163 SEQ ID NO: 221 | 9049 |
| HIV1431 | Light chain | VRC01HC/ VRC03LC | WO2013090644 SEQ ID NO: 31 | 9050 |
| HIV1432 | Light chain | VRC01hpL02 | US2014 0322163 SEQ ID NO: 50 | 9051 |
| HIV1433 | Light chain | VRC01hpL02 E1/I2-deletion, V3S | US2014 0322163 SEQ ID NO: 232 | 9052 |
| HIV1434 | Light chain | VRC01hpL03 | US2014 0322163 SEQ ID NO: 228 | 9053 |
| HIV1435 | Light chain | VRC01hpL04 | US2014 0322163 SEQ ID NO: 229 | 9054 |
| HIV1436 | Light chain | VRC01hpL05 | US2014 0322163 SEQ ID NO: 230 | 9055 |
| HIV1437 | Light chain | VRC01hpL06 | US2014 0322163 SEQ ID NO: 231 | 9056 |
| HIV1438 | Light chain | VRC01LhpL 03 E1/I2-deletion, V3S | US2014 0322163 SEQ ID NO: 233 | 9057 |
| HIV1439 | Light chain | VRC01LhpL 04 E1/I2-deletion, V3E | US2014 0322163 SEQ ID NO: 237 | 9058 |
| HIV1440 | Light chain | VRC01LhpL 04 E1/I2-deletion, V3S | US2014 0322163 SEQ ID NO: 234 | 9059 |
| HIV1441 | Light chain | VRC01LhpL 05 E1/I2 deletion, V3S | US2014 0322163 SEQ ID NO: 235 | 9060 |
| HIV1442 | Light chain | VRC01LhpL 06 E1/I2-deletion, V3S | US2014 0322163 SEQ ID NO: 236 | 9061 |
| HIV1443 | Light chain | VRC02 | U.S. Pat. No. 8,637,036B2 SEQ ID NO: 4 | 9062 |
| HIV1444 | Light chain | VRC03 | U.S. Pat. No. 8,637,036B2 SEQ ID NO: 28 | 9063 |
| HIV1445 | Light chain | VRC03HC-VRC01LC | WO2013090644 SEQ ID NO: 1 | 9064 |
| HIV1446 | Light chain | Vrc06b | Wu, X., et al., Maturation and Diversity of the VRC01-Antibody Lineage over 15 Years of Chronic HIV-1 Infection; Cell 161 (3), 470-485 (2015), NCBI Accession # 4XNZ_F (209aa) | 9065 |
| HIV1447 | Light chain | Vrc08c | Wu, X., et al., Maturation and Diversity of the VRC01-Antibody Lineage over 15 Years of Chronic HIV-1 Infection; Cell 161 (3), 470-485 (2015), NCBI Accession # 4XNY_L (211aa) | 9066 |
| HIV1448 | Light chain | Vrc23 | Georgiev, I. S., et al., Delineating antibody recognition in polyclonal sera from patterns of HIV-1 isolate neutralization; Science 340 (6133), 751-756 (2013), NCBI Accession # 4J6R_L (210aa) | 9067 |
| HIV1449 | Light chain | VRC-CH30 | WO2013090644 SEQ ID NO: 21 | 9068 |
| HIV1450 | Light chain | Vrc-ch31 | Zhou T et al., Immunity 39 (2), 245-258 (2013), NCBI Accession # 4LSP_L (210aa) | 9069 |
| HIV1451 | Light chain | VRC-CH32 | Wu X. et al., "Focused evolution of HIV-1 neutralizing antibodies revealed by structures and deep sequencing" Science 333 (6049), 1593-1602 (2011), NCBI Accession # AEM62727 | 9070 |

TABLE 42-continued

HIV Antibodies

| Antibody No. | Description | Antibody Name | Reference Information | SEQ ID NO |
|---|---|---|---|---|
| HIV1452 | Light chain | VRC-CH33 | WO2013090644 SEQ ID NO: 27 | 9071 |
| HIV1453 | Light chain | VRC-CH34 | WO2013090644 SEQ ID NO: 29 | 9072 |
| HIV1454 | Light chain | VRC-PG04 | Wu X. et al,"Focused evolution of HIV-1 neutralizing antibodies revealed by structures and deep sequencing" Science 333 (6049), 1593-1602 (2011), NCBI Accession # AEM62754 | 9073 |
| HIV1455 | Light chain | VRC-PG04b | WO2013090644 SEQ ID NO: 43 | 9074 |
| HIV1456 | Light chain | Vrc-pg20 | Zhou T et al., immunity 39 (2), 245-258 (2013), NCBI Accession # 4LSU_L (204aa) | 9075 |
| HIV1457 | Light chain | X5 | U.S. Pat. No. 7,378,093B2 SEQ ID NO: 2 | 9076 |
| HIV1458 | Light chain | X5 | U.S. Pat. No. 8,110,192B2 SEQ ID NO: 4 | 9077 |
| HIV1459 | Light chain | Z13e1 | Stanfield. R. L., et al, J. Mol. Biol. 414 (3), 460-476 (2011), NCBI Accession # 3Q1S_L (212aa) | 9078 |
| HIV1460 | Light Chain | Z258-vrc27.01 | Zhon T et al., Structural Repertoire of HIV-1-Neutralizing Antibodies Targeting the CD4 Supersite in 14 Donors; Cell 161 (6), 1280-1292 (2015), NCBI Accession # 4YDI_L (210aa) | 9079 |
| HIV1461 | Light chain | | NCBI Accession # 1N0X_M (215aa) | 9080 |
| HIV1462 | Light chain | | Okada, N., et al., Human IgM Monoclonal Antibodies Reactive with HIV-1-Infected Cells Generated Using a Trans-Chromosome Mouse; Microbiol. Immunol. 49 (5), 447-459 (2005), NCBI Accession # AAS01772.1(236aa) | 9081 |
| HIV1463 | Light chain | | U.S. Pat. No. 5,804,440A SEQ ID NO: 101 | 9082 |
| HIV1464 | Light chain | | U.S. Pat. No. 5,804,440A SEQ ID NO: 102 | 9083 |
| HIV1465 | Light chain | | U.S. Pat. No. 5,804,440A SEQ ID NO: 103 | 9084 |
| HIV1466 | Light chain | | U.S. Pat. No. 5,804,440A SEQ ID NO: 104 | 9085 |
| HIV1467 | Light chain | | U.S. Pat. No. 5,804,440A SEQ ID NO: 105 | 9086 |
| HIV1468 | Light chain | | U.S. Pat. No. 5,804,440A SEQ ID NO: 107 | 9087 |
| HIV1469 | Light chain | | U.S. Pat. No. 5,804,440A SEQ ID NO: 110 | 9088 |
| HIV1470 | Light chain | | U.S. Pat. No. 5,804,440A SEQ ID NO: 115 | 9089 |
| HIV1471 | Light chain | | U.S. Pat. No. 5,804,440A SEQ ID NO: 118 | 9090 |
| HIV1472 | Light chain | | U.S. Pat. No. 5,804,440A SEQ ID NO: 121 | 9091 |
| HIV1473 | Light chain | | U.S. Pat. No. 5,804,440A SEQ ID NO: 122 | 9092 |
| HIV1474 | Light chain | | U.S. Pat. No. 5,804,440A SEQ ID NO: 124 | 9093 |
| HIV1475 | Light chain | | U.S. Pat. No. 5,804,440A SEQ ID NO: 132 | 9094 |
| HIV1476 | Light chain | | U.S. Pat. No. 5,804,440A SEQ ID NO: 147 | 9095 |
| HIV1477 | Light chain | | U.S. Pat. No. 5,804,440A SEQ ID NO: 148 | 9096 |
| HIV1478 | Light chain | | U.S. Pat. No. 5,804,440A SEQ ID NO: 149 | 9097 |
| HIV1479 | Light chain | | U.S. Pat. No. 5,804,440A SEQ ID NO: 150 | 9098 |
| HIV1480 | Light chain | | U.S. Pat. No. 5,804,440A SEQ ID NO: 151 | 9099 |
| HIV1481 | Light chain | | U.S. Pat. No. 5,804,440A SEQ ID NO: 95 | 9100 |
| HIV1482 | Light chain | | U.S. Pat. No. 5,804,440A SEQ ID NO: 96 | 9101 |
| HIV1483 | Light chain | | U.S. Pat. No. 5,804,440A SEQ ID NO: 97 | 9102 |
| HIV1484 | Light chain | | U.S. Pat. No. 5,804,440A SEQ ID NO: 98 | 9103 |
| HIV1485 | Light chain | | WO2014063059 SEQ ID NO: 11 | 9104 |
| HIV1486 | Light chain | | WO2014063059 SEQ ID NO: 129 | 9105 |
| HIV1487 | Light chain | | WO2014063059 SEQ ID NO: 13 | 9106 |
| HIV1488 | Light chain | | WO2014063059 SEQ ID NO: 15 | 9107 |
| HIV1489 | Light chain | | WO2014063059 SEQ ID NO: 17 | 9108 |
| HIV1490 | Light chain | | WO2014063059 SEQ ID NO: 19 | 9109 |
| HIV1491 | Light chain | | WO2014063059 SEQ ID NO: 21 | 9110 |
| HIV1492 | Light chain | | WO2014063059 SEQ ID NO: 23 | 9111 |
| HIV1493 | Light chain | | WO2014063059 SEQ ID NO: 3 | 9112 |
| HIV1494 | Light chain | | WO2014063059 SEQ ID NO: 5 | 9113 |
| HIV1495 | Light chain | | WO2014063059 SEQ ID NO: 7 | 9114 |
| HIV1496 | Light chain | | WO2014063059 SEQ ID NO: 9 | 9115 |
| HIV1497 | Light chain consensus | | WO2014063059 SEQ ID NO: 1 | 9116 |
| HIV1498 | Light chain constant region | TNX-355, Idalizumab | US20130195881 SEQ ID NO: 2 | 9117 |
| HIV1499 | Light Chain Fab | Ch02 | McLellan, J. S., et al., Nature 480 (7377), 336-343 (2011), NCBI Accession # 3U46_B (215aa) | 9118 |
| HIV1500 | Light Chain Of Anti-HIV Fab From Human 21c Antibody | 21C | Diskin, R., et al., Nat. Struct. Mol. Biol. 17 (5), 608-613 (2010), NCBI Accession # 3LMJ_L (217aa) | 9119 |
| HIV1501 | Light Chain Of Anti-hiv-1 Gp120 V1v2 Antibody 830a | 830a | Pan et al., J. Virol. 89 (15), 8003-8010 (2015), NCBI Accession # 4YWG_L (216aa) | 9120 |

TABLE 42-continued

HIV Antibodies

| Antibody No. | Description | Antibody Name | Reference Information | SEQ ID NO |
|---|---|---|---|---|
| HIV1502 | Light Chain Of Anti-hiv-1 V3 Monoclonal Antibody | Fab 2558 | Gorny et al., PLoS ONE 6 (12), E27780 (2011), NCBI Accession # 3UJI_L (209aa) | 9121 |
| HIV1503 | Light Chain Of Anti-hiv-1 V3 Monoclonal Antibody | Fab 4025 | Gorny et al., PLoS ONE 6 (12), E27780 (2011), NCBI Accession # 3UJJ_L (213aa) | 9122 |
| HIV1504 | Light chain partial | 412D | Huang C. et al "Structural basis of tyrosine sulfation and VH-gene usage in antibodies that recognize the HIV type 1 coreceptor-binding site on gp120" Proc. Natl. Acad. Sci. U.S.A. 101 (9), 2706-2711 (2004), NCBI Accession # AAR88380 | 9123 |
| HIV1505 | Light chain partial | 694/98D | Li L. et al, "A broad range of mutations in HIV-1 neutralizing human monoclonal antibodies specific for V2, V3, and the CD4 binding site", Mol. Immunol. 66 (2), 364-374 (2015); NCBI Accession # AKH36512 | 9124 |
| HIV1506 | Light chain variable region | 0.5γ (1C10) | U.S. Pat. No. 8,722,861B2 SEQ ID NO: 2 | 9125 |
| HIV1507 | Light chain variable region | 0.5γ (3D6) | U.S. Pat. No. 8,722,861B2 SEQ ID NO: 6 | 9126 |
| HIV1508 | Light chain variable region | 10J4 mAb | WO2015103549 SEQ ID NO: 4 | 9127 |
| HIV1509 | Light chain variable region | 10M6 mAb | WO2015103549 SEQ ID NO: 6 | 9128 |
| HIV1510 | Light chain variable region | 13110 mAb | WO2015103549 SEQ ID NO: 8 | 9129 |
| HIV1511 | Light chain variable region | 2N5mAb | WO2015103549 SEQ ID NO: 10 | 9130 |
| HIV1512 | Light chain variable region | 35022 mAb | WO2015103549 SEQ ID NO: 2 | 9131 |
| HIV1513 | Light chain variable region | 42F9 | U.S. Pat. No. 8,722,861B2 SEQ ID NO: 8 | 9132 |
| HIV1514 | Light chain variable region | 49G2 | U.S. Pat. No. 8,722,861B2 SEQ ID NO: 10 | 9133 |
| HIV1515 | Light chain variable region | 4O20mAb | WO2015103549 SEQ ID NO: 12 | 9134 |
| HIV1516 | Light chain variable region | 5G2 | U.S. Pat. No. 8,722,861B2 SEQ ID NO: 4 | 9135 |
| HIV1517 | Light chain variable region | 7B9mAb | WO2015103549 SEQ ID NO: 14 | 9136 |
| HIV1518 | Light chain variable region | 7K3mAb | WO2015103549 SEQ ID NO: 16 | 9137 |
| HIV1519 | Light chain variable region | B4 | U.S. Pat. No. 7,872,110B2 SEQ ID NO: 4 | 9138 |
| HIV1520 | Light chain variable region | B4DIVKv.1 | U.S. Pat. No. 7,872,110B2 SEQ ID NO: 9 | 9139 |
| HIV1521 | Light chain variable region | B4DIVKv.2 | U.S. Pat. No. 7,872,110B2 SEQ ID NO: 10 | 9140 |
| HIV1522 | Light chain variable region | B4DIVKv.3 | U.S. Pat. No. 7,872,110B2 SEQ ID NO: 11 | 9141 |
| HIV1523 | Light chain variable region | bl2 IgA2 antibody | WO2014040024 SEQ ID NO: 30 | 9142 |
| HIV1524 | Light chain variable region | CHμ39.1 | U.S. Pat. No. 5,773,247 SEQ ID NO: 12 | 9143 |
| HIV1525 | Light chain variable region | CHμ5.5 | U.S. Pat. No. 5,773,247 SEQ ID NO: 16 | 9144 |
| HIV1526 | Light chain variable region | F425-Alg8 antibody | WO2014040024 SEQ ID NO: 13 | 9145 |
| HIV1527 | Light chain variable region | Fab 43 | US20090191216 SEQ ID NO: 9 | 9146 |
| HIV1528 | Light chain variable region | HGN194 | US20110212106 SEQ ID NO: 46 | 9147 |
| HIV1529 | Light chain variable region | HJ16 | US20110212106 SEQ ID NO: 14 | 9148 |
| HIV1530 | Light chain variable region | HK20 | US20110212106 SEQ ID NO: 30 | 9149 |
| HIV1531 | Light chain variable region | IgA antibody | WO2014040024 SEQ ID NO: 15 | 9150 |
| HIV1532 | Light chain variable region | Makandal monoclonal antibody (Mmab) | US20100111990 SEQ ID NO: 3 | 9151 |

TABLE 42-continued

HIV Antibodies

| Antibody No. | Description | Antibody Name | Reference Information | SEQ ID NO |
|---|---|---|---|---|
| HIV1533 | Light chain variable region | NM-01 | U.S. Pat. No. 5,665,569 SEQ ID NO: 18 | 9152 |
| HIV1534 | Light chain variable region | NM-01 HuVH | U.S. Pat. No. 5,665,569 SEQ ID NO: 28 | 9153 |
| HIV1535 | Light chain variable region | NM-01 HuVK | U.S. Pat. No. 5,665,569 SEQ ID NO: 30 | 9154 |
| HIV1536 | Light chain variable region | NM-01 HuVKF | U.S. Pat. No. 5,665,569 SEQ ID NO: 32 | 9155 |
| HIV1537 | Light chain variable region | PGT125 | Walker L. M. et al "Broad neutralization coverage of HIV by multiple highly potent antibodies", Nature 477 (7365), 466-470 (2011), NCBI Accession # AEN14410 | 9156 |
| HIV1538 | Light chain variable region | PGT126 | Walker L. M. et al "Broad neutralization coverage of HIV by multiple highly potent antibodies", Nature 477 (7365), 466-470 (2011), NCBI Accession # AEN14411 | 9157 |
| HIV1539 | Light chain variable region | PGT131 | Walker L. M. et al "Broad neutralization coverage of HIV by multiple highly potent antibodies", Nature 477 (7365), 466-470 (2011), NCBI Accession # AENT4415 | 9158 |
| HIV1540 | Light chain variable region | PGT136 | Walker L. M. et al "Broad neutralization coverage of HIV by multiple highly potent antibodies", Nature 477 (7365), 466-470 (2011), NCBI Accession # AEN14417 | 9159 |
| HIV1541 | Light chain variable region | PGT137 | Walker L. M. et al "Broad neutralization coverage of HIV by multiple highly potent antibodies", Nature 477 (7365), 466-470 (2011), NCBI Accession # AEN14418 | 9160 |
| HIV1542 | Light chain variable region | PGT141 | Walker L. M. et al "Broad neutralization coverage of HIV by multiple highly potent antibodies", Nature 477 (7365), 466-470 (2011), NCBI Accession# AEN14419 | 9161 |
| HIV1543 | Light chain variable region | PGT142 | Walker L.M. et al "Broad neutralization coverage of HIV by multiple highly potent antibodies", Nature 477 (7365), 466-470 (20 1 I), NCBI Accessiots # AEN14385 | 9162 |
| HIV1544 | Light chain variable region | PGT143 | Walker L.M. et al "Broad neutralization coverage of HIV by multiple liighly potent antibodies". Nature 477 (7365), 466-470 (2011), NCBI Accession # AEN14421 | 9163 |
| HIV1545 | Light chain variable region | PGT144 | Walker L.M. et al "Broad neutralization coverage of HIV by multiple highly potent antibodies", Nature 477 (7365), 466-470 (2011), NCBI Accession # AEN14422 | 9164 |
| HIV1546 | Light chain variable region | PGT151 | Falkowska, E. et al "Broadly Neutralizing HIV Antibodies Define a Gly can-Dependent Epitope on the Prefusion Conformation of gp41 on Cleaved Envelope Trimers" Immunity 40 (5), 657-668 (2014), NCBI Accession # AIC32543 | 9165 |
| HIV1547 | Light chain variable region | PGT152 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32544 | 9166 |
| HIV1548 | Light chain variable region | PGT153 | Falkowska, E. et al "Broadly Neutralizing HIV Antibodies Define a Glycan-Dependent Epitope on the Profusion Conformation of gp41 on Cleaved Envelope Trimers" Immunity 40 (>). 657-668 (2014), NCBI Accession # AIC32545 | 9167 |
| HIV1549 | Light chain variable region | PGT154 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32529 | 9168 |
| HIV1550 | Light chain variable region | PGT155 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32547 | 9169 |
| HIV1551 | Light chain variable region | PGT156 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32548 | 9170 |

TABLE 42-continued

HIV Antibodies

| Antibody No. | Description | Antibody Name | Reference Information | SEQ ID NO |
|---|---|---|---|---|
| HIV1552 | Light chain variable region | PGT157 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32549 | 9171 |
| HIV1553 | Light chain variable region | PGTI58 | Falkowska, E. et al "Broadly Neutralizing HIV Antibodies Define a Glycan-Dependent Epitope on the Prefusion Conformation of gp41 on Cleaved Envelope Trimers" Immunity 40 (5), 657-668 (2014), NCBI Accession # AIC32550 | 9172 |
| HIV1554 | Light chain variable region | rF105 | WO1993012232 SEQ ID NO: 3 | 9173 |
| HIV1555 | Light chain variable region | ScFvX5-CD4 | U.S. Pat. No. 7,378,093B2 SEQ ID NO: 15 | 9174 |
| HIV1556 | Light chain variable region | TNX-355, Idalizumab | US20130195881 SEQ ID NO: 1 | 9175 |
| HIV1557 | Light chain variable region | VCR14 | US20150044137 SEQ ID NO: 25 | 9176 |
| HIV1558 | Light chain variable region | VCR14b | US20150044137 SEQ ID NO: 26 | 9177 |
| HIV1559 | Light chain variable region | VCR14c | US20150044137 SEQ ID NO: 27 | 9178 |
| HIV1560 | Light chain variable region | VCR16 | US20150044137 SEQ ID NO: 33 | 9179 |
| HIV1561 | Light chain variable region | VCR16b | US20150044137 SEQ ID NO: 34 | 9180 |
| HIV1562 | Light chain variable region | VCR16c | US20150044137 SEQ ID NO: 35 | 9181 |
| HIV1563 | Light chain variable region | VCR16d | US20150044137 SEQ ID NO: 36 | 9182 |
| HIV1564 | Light chain variable region | VRC13 | US20150044137 SEQ ID NO: 17 | 9183 |
| HIV1565 | Light chain variable region | VRC13b | US20150044137 SEQ ID NO: 18 | 9184 |
| HIV1566 | Light chain variable region | VRC13c | US20150044137 SEQ ID NO: 19 | 9185 |
| HIV1567 | Light chain variable region | VRC13d | US20150044137 SEQ ID NO: 20 | 9186 |
| HIV1568 | Light chain variable region | VRC13e | US20150044137 SEQ ID NO: 21 | 9187 |
| HIV1569 | Light chain variable region | VRC13f | US20150044137 SEQ ID NO: 22 | 9188 |
| HIV1570 | Light chain variable region | VRC13g | US20150044137 SEQ ID NO: 23 | 9189 |
| HIV1571 | Light chain variable region | VRC13h | US20150044137 SEQ ID NO: 24 | 9190 |
| HIV1572 | Light chain variable region | VRC15 | US20150044137 SEQ ID NO: 28 | 9191 |
| HIV1573 | Light chain variable region | | US20150004190 SEQ ID NO: 57 | 9192 |
| HIV1574 | Light Chain, Fab | Ch04 | McLellan, J. S. et al., Structure of HIV-1 gp120 V1 V2 domain with broadly neutralizing antibody PC9; Nature 480 (7377), 336-343 (2011), NCBI Accession # 3TCL_B (215aa) | 9193 |
| HIV1575 | Light Chain, Fab | N5-i5 | Acharya, P., et al., Structural Definition of an Antibody-Dependent Cellular Cytotoxicity Response Implicated in Reduced Risk for HIV-1 Infection; J. Virol. 88 (21), 12895-12906 (2014), NCBI Accession # 4H8W_L (217aa) | 9194 |
| HIV1576 | Light Chain, Ig Kappa Chain C Region | Nih45-46 Fab | Diskin, R., et al., Science 334 (6060), 1289-1293 (2011), NCBI Accession # 3U7Y_L (210aa) | 9195 |
| HIV1577 | Light Chain, Ig Lambda-2 Chain C region | Pgt127 | Pejchal, R., et al., Science 334 (6059), 1097-1103 (2011), NCBI Accession # 3TWC_L(211aa) | 9196 |
| HIV1578 | Light Chain, Ig Kappa Chain C Region | 7b2 | Santra, S., et al., PLoS Pathol. 11 (8), E1005042 (2015), NCBI Accession # 4YDV_L (265aa) | 9197 |
| HIV1579 | Light Chain; Fab | N60-i3 | Gohain, N., et al., Cocrystal Structures of Antibody N60-i3 and Antibody JR4 in Complex with gp120 Define More Cluster A Epitopes Invoked in Effective Antibody-Dependent Effector Function against HIV-1; J. | 9198 |

TABLE 42-continued

HIV Antibodies

| Antibody No. | Description | Antibody Name | Reference Information | SEQ ID NO |
|---|---|---|---|---|
| HIV1580 | Light Chain; Ig Lambda-2 Chain C region | Pgt128 | Virol. 89 (17), 8840-8854 (2015), NCBI Accession # 4RFO_L (221aa) Pejchal, R., et al., Science 334 (6059), 1097-1103 (2011), NCBI Accession # 3TV3_L (211aa) | 9199 |
| HIV1581 | Scfv | B11 | U.S. Pat. No. 7,744,887B2 SEQ ID NO: 8 | 9200 |
| HIV1582 | Scfv | | U.S. Pat. No. 8,110,192B2 SEQ ID NO: 1 | 9201 |
| HIV1583 | Scfv | | U.S. Pat. No. 8,110,192B2 SEQ ID NO: 2 | 9202 |
| HIV1584 | Scfv | | U.S. Pat. No. 8,110,192B2 SEQ ID NO: 3 | 9203 |
| HIV1585 | Scfv (SEQRES) | 3b3 variant | Clark et al., Protein Sci. 18 (12), 2429-2441 (2009), NCBI Accession # 3JUY_A (256aa) | 9204 |
| HIV1586 | Scfv | D5 | U.S. Pat. No. 7,744,887B2 SEQ ID NO: 2 | 9205 |
| HIV1587 | Scfv-cd4 fusion protein | | U.S. Pat. No. 8,110,192B2 SEQ ID NO: 8 | 9206 |
| HIV1588 | | 447-52d | Dhillon, A. K., et al., Acta Crystallogr. D Biol. Crystallogr. D64 (PT 7), 792-802 (2008), NCBI Accession # 3C2A_1(231aa) | 9207 |
| HIV1589 | | 447-52d | Dhillon, A. K., et al., Acta Crystallogr, D Biol. Crystallogr. D64 (PT 7), 792-802 (2008), NCBI Accession # 3C2A_M (216aa) | 9208 |
| HIV1590 | | F105 | Wilkinson, R. A., et al., J. Virol. 79 (20), 13060-13069 (2005), NCBI Accession # 1U6A_H (224aa) | 9209 |
| HIV1591 | | F105 | Wilkinson, R. A., et al., J. Virol. 79 (20), 13060-13069 (2005), NCBI Accession # 1U6A_L (215aa) | 9210 |
| HIV1592 | | Fab 8062 | Frisch, C., et al., PLoS Pathol. 6 (11), E1001182 (2010), NCBI Accession # 3MAC_H (245aa) | 9211 |
| HIV1593 | | Fab 8062 | Frisch, C., et al., PLoS Pathol. 6 (11), E1001182 (2010), NCBI Accession # 3MAC_L (213aa) | 9212 |
| HIV1594 | | Fab 8066 | Frisch, C., et al., PLoS Pathol. 6 (11), E1001182 (2010), NCBI Accession # 3MA9_H (245aa) | 9213 |
| HIV1595 | | Fab 8066 | Frisch, C., et al., PLoS Pathol. 6 (11), E1001182 (2010), NCBI Accession # 3MA9_L (213aa) | 9214 |
| HIV1596 | | Fab'2F5 fragment | U.S. Pat. No. 6,482,928 SEQ ID NO: 6 | 9215 |
| HIV1597 | | Fab'2F5 fragment | U.S. Pat. No. 6,482,928 SEQ ID NO: 7 | 9216 |
| HIV1598 | | M18 Fab | Prabakaran, P., et al., J. Mol. Biol. 357 (1), 82-99 (2006), NCBI Accession # 2AJ3_D (228aa) | 9217 |
| HIV1599 | | M18 Fab | Prabakaran, P., et al., J. Mol. Biol. 357 (1), 82-99 (2006), NCBI Accession # 2AJ3_E (213aa) | 9218 |
| HIV1600 | | Pg16 | Pancera, M. et al., J. Virol. 84 (16), 8098-8110 (2010), NCBI Accession # 3MME_A (238aa) | 9219 |
| HIV1601 | | Pg16 | Paneera, M, et al., J. Virol. 84 (16), 8098-8110 (2010), NCBI Accession # 3MME_B (216aa) | 9220 |

In one embodiment, the payload region of the AAV particle comprises one or more nucleic acid sequences, fragment or variants thereof or encodes one or more polypeptides, fragments or variants thereof described in European Patent Publication No. EP327000, EP478689, EP554401, EP581353 and EP711439, US Publication No US20110104163, US20110212106, US20130215726 and US20130251726, U.S. Pat. Nos. 5,266,479, 5,804,440, 6,657,050, 8,637,036, and 9,090,675, and International Publication No. WO2012154312, WO2013163427, WO2014043386, WO2015048462, WO2015048610, WO2015048770 the contents of each of which are herein incorporated by reference in their entirety, against HIV.

Disease Specific Epitopes, Innate Defense Regulator Peptides, Cyclic Peptides

In one embodiment, the viral genomes of the AAV particles may comprise nucleic acids which have been engineered to enable expression of antibodies binding to disease-specific epitopes of proteins. Such antibodies may be used to diagnose, prevent, and/or treat the corresponding medical conditions by targeting epitopes of the protein presented by or accessible on native or non-native forms (e.g., misfolded forms of native proteins) of the target Such epitopes may be specific to diseases involved with misfolding of a protein due to pathologic condition and resulting in misfolded aggregates. The disease-specific proteins are considered to be toxic to neurons and to have a role in neuronal cell death and dysfunction in neurodegenerative diseases including, but not limited to. Alzheimer's disease (AD), armyotrophic lateral sclerosis (ALS), Parkinson's disease, dementia by Lew body (DLB), and prion diseases. e.g. Creutzfeldt-Jakob disease (CJD), Gerstmann-Straussler-Scheinker syndrome (GSS), kuru, and fatal farnilial insomnia (FFI).

In one embodiment, the encoded disease-specific epitopes may include epitopes on SOD1 that are revealed as SOD1 (Superoxide dismutase [Cu—Zn]) dissociates from its homodimeric, normal state. The SOD epitopes may be selectively presented or accessible in non-native SOD1 forms including misfolded SOD1 monomer, misfolded SOD1 dimer, and the epitopes selectively presented or accessible in SOD1 aggregates. Such epitopes may be specific to neurodegenerative diseases including, but not limited to, amyotrophic lateral sclerosis (ALS), Alzheimer's (AD). Parkinson's (PD), and Lewr body diseases (LBD).

In one embodiment, the expressed antibodies may bind to epitopes presented by or accessible on non-native forms of SOD1, such as those presented by SEQ ID NO: 2, 3, 5, 6, and 7 of U.S. Pat. No. 7,977,314 (the contents of which are herein incorporated by reference in its entirety), or presented by or accessible on monomeric forms of SOD1, such as those presented by SEQ ID NOs: 1 and 4 of U.S. Pat. No. 7,977,314, the contents of which are herein incorporated by reference in their entirety. In one embodiment, the expressed antibodies may comprise isolated peptides corresponding to such epitopes, such as those presented in SEQ ID NOs: 1-8 or SEQ ID NOs-8-16, or epitopes presented by SEQ ID NOs: 34-63, 65-79 of U.S. Pat. No. 7,977,314, the contents of which are herein incorporated by reference in their entirety.

In one embodiment, the encoded disease-specific epitopes may be specific to diseases associated with prion protein (PrP), familial amyloid polyneuropathy or senile systemic amyloidosis or a disease related by the presence of misfolded transthyretine (TTR); renal accumulation of 1(2 microglobulin amyloid deposits or a disease related by the presence of misfolded D12 microglobulin, amyotrophic lateral sclerosis (ALS) or a disease related by the presence of misfolded SOD1; leukemias or myelomas or a disease related by the presence of misfolded cluster of differentiation 38 (CD38); colon cancer metastasis and or a disease related by the presence of misfolded cluster of differentiation (CD44); tumors associated with tumor necrosis factor receptor (TNFR); cancers including cervical, head and neck, endometrial, lung and breast carcinomas, pleural mesotheliomas, malignant melanomas, Hodgkin lymphomas, anaplastic large cell non-Hodgkin lymphomas, or a disease related by the presence of misfolded Notch homolog 1 (NOTCH1) e.g. acute myeloid leukemias and B-cell chronic lymphoid leukemias; cancer in which Fas receptor (FasR) is implicated, cancers and related disorders in which misfolded epidermal growth factor (EGFR) is implicated; and/or other related diseases, disorders and conditions.

In one embodiment, the encoded disease specific epitopes may include epitopes that are revealed as the proteins misfold. In one embodiment, the expressed antibodies may bind to predicted epitopes of human PrP, such as those presented by SEQ ID NOs: 1-10 of US Patent Publication No. US20100233176; bovine PrP, such as those presented by SEQ ID NOs: 11-15 of US Patent Publication No. US20100233176. TTR, such as those presented by SEQ ID NOs: 16-22 of US Patent Publication No US20100233176; beta-2 microglobulin, such as those presented by SEQ ID NOs: 23-26 of US Patent Publication No. US20100233176; SOD1, such as those presented by SEQ ID NOs: 27-40 of US Patent Publication No. US201100233176; CD38, such as those presented by SEQ ID NOs: 41-45 of US Patent Publication No. US20100233176; CD44, such as those presented by 46-50 of US Patent Publication No. US20100233176; TNFR, such as those presented by 51-55 of US Patent Publication No. US20100233176; notch protein, such as those presented in SEQ ID NOs: 56-60 of US Patent Publication No US201100233176; FasR, such as those presented by SEQ ID NOs: 61-65 of US Patent Publication No. US20100233176 and EGFR, such as those presented by SEQ ID NOs: 66-80 of US Patent Publication No. US20100233176; the contents of which are herein incorporated by reference in their entirety.

In one embodiment, the expressed antibodies may comprise peptides corresponding to such epitopes. In one embodiment, the expressed antibodies may comprise prion-specific peptides, such as those presented by SEQ ID NOs: 81-88 of US Patent Publication No. US20100233176, the contents of which are herein incorporated by reference in their entirety, and variations thereof.

In one embodiment, the encoded disease-specific epitopes may be specific to prion diseases, including transmissible spongiform encephalopathies (TSEs) or other prion diseases. In one embodiment, the expressed antibodies may bind to predicted epitopes of PrP, such as those presented by SEQ ID NOs: 24, 26, 28, 30, 32, 34, 36, 39-43, of US Patent Publication No. US20150004185, the contents of which are herein incorporated by reference in their entirety. In one embodiment, the expressed antibodies may comprise prion-specific peptides or peptide fusions, such as those presented by SEQ ID NOs: 12-23, 25, 27, 29, 31, 33, 35, 37, 38, 43, and 44-48 of US Patent Publication No. US20150004185, the contents of which are herein incorporated by reference in their entirety.

In one embodiment, the expressed antibodies may comprise prion peptides binding to prion specific abnormal isoform of the prion protein, such as those presented by SEQ ID NOs: 2-10 of US Patent Publication No. US20040072236, the contents of which are herein incorporated by reference in their entirety.

In one embodiment, the viral genomes of the AAV particles may comprise nucleic acids which have been engineered to express innate defense regulator (IDR) peptides. IDRs are immunomodulatory peptides that act directly on cells to effect an innate immune response. Such IDRs may be used to treat neurodegenerative diseases associated with neuroinflammation, e.g. amyotrophic lateral sclerosis (ALS), Alzheimer's disease, Friedreich's ataxia. Huntington's disease, Lewr body disease, Parkinson's disease, spinal muscular atrophy, and multiple sclerosis (MS) and other neurodegenerative diseases. In one embodiment, IDRs may be those presented by SEQ ID NOS: 1-969, and 973-1264 of International Publication No. WO2013034982, the contents of which are herein incorporated by reference in their entirety, or analogs, derivatives, amidated variations and conservative variations thereof.

In one embodiment, the viral genomes of the AAV particles may comprise nucleic acids which have been engineered to express antibodies binding to an epitope of the Tropomyosin receptor kinase (TrkC) receptor. Such antibodies may comprise a peptide, such as one presented by SEQ ID NO: 1 of U.S. Pat. No. 9,200,080, the contents of which are herein incorporated by reference in their entirety.

In some embodiments, the viral genomes of the AAV particles may comprise nucleic acids which have been engineered to express cyclic peptides with an amino acid sequence SNK, Non-limiting examples of other cyclic peptides include SEQ ID NO: 1-7 of U.S. Pat. No. 9,216,217, the contents of which are herein incorporated by reference in their entirety. The method of preparing the antibodies may include hyperimmune preparation method, as described in U.S. Pat. No. 9,216,217, the contents of which are herein incorporated by reference in their entirety.

Prions

In one embodiment, the viral genomes of the AAV particles may comprise a nucleic acid sequence encoding antibodies comprising prion peptides comprising prion epitopes, and fusions and repeats thereof, such as those presented by SEQ ID NOs: 8-32, 35, and 36 of U.S. Pat. No. 9,056,918, the contents of which are herein incorporated by reference in their entirety.

In one embodiment, the viral genomes of the AAV particles may comprise a nucleic acid sequence encoding prion binding proteins (PrPBP). In one embodiment, the PrPBPs are cadherins, such as those presented by SEQ ID NOs: 1 and 2 of International Publication WO 1997/045746, the contents of which are herein incorporated by reference in their entirety. In one embodiment, the PrPBPs are cadherins, such as those presented by SEQ ID NOs: 2 and 7-9 of International Publication No. WO2001000235, the contents of which are herein incorporated by reference in their entirety.

The Nature of the Polypeptides and Variants

Antibodies encoded by payload regions of the viral genomes of the invention may be translated as a whole polypeptide, a plurality of polypeptides or fragments of polypeptides, which independently may be encoded by one or more nucleic acids, fragments of nucleic acids or variants of any of the aforementioned. As used herein, "polypeptide" means a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

The term "amino acid sequence variant" refers to molecules with some differences in their amino acid sequences as compared to a native or starting sequence. The amino acid sequence variants may possess substitutions, deletions, and/or insertions at certain positions within the amino acid sequence. "Native" or "starting" sequence should not be confused with a wild type sequence. As used herein, a native or starting sequence is a relative term referring to an original molecule against which a comparison may be made. "Native" or "starting" sequences or molecules may represent the wild-type (that sequence found in nature) but do not have to be the wild-type sequence.

Ordinarily, variants will possess at least about 70% homology to a native sequence, and preferably, they will be at least about 80%, more preferably at least about 90% homologous to a native sequence. "Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to amino acid sequences is meant the corresponding sequence of other species having substantial identity to a second sequence of a second species.

"Analogs" is meant to include polypeptide variants which differ by one or more amino acid alterations, e.g., substitutions, additions or deletions of amino acid residues that still maintain the properties of the parent polypeptide.

Sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutanane, glutamic acid or lysine and/or a polar residue for a non-polar residue.

"Insertional variants" when referring to proteins are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to proteins, are those with one or more amino acids in the native or starting amino acid sequence removed. Ordinarily, deletional variants will have one or more amino acids deleted in a particular region of the molecule.

As used herein, the term "derivative" is used synonymously with the term "variant" and refers to a molecule that has been modified or changed in any way relative to a reference molecule or starting molecule. In some embodiments, derivatives include native or starting proteins that have been modified with an organic proteinaceous or non-proteinaceous derivatizing agent, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deaminated to the corresponding glutamyl and aspartyl residues. Alternatively, these residues are deaminated under mildly acidic conditions. Either form of these residues may be present in the proteins used in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to proteins are defined as distinct amino acid sequence-based components of a molecule. Features of the proteins of the present invention include surface manifestations, local conformational shape, folds, loops, half-loops, domains, half-domains, sites, termini or any combination thereof.

As used herein when referring to proteins the term "surface manifestation" refers to a polypeptide based component of a protein appearing on an outermost surface.

As used herein when referring to proteins the term "local conformational shape" means a polypeptide based structural manifestation of a protein which is located within a definable space of the protein.

As used herein when referring to proteins the term "fold" means the resultant conformation of an amino acid sequence upon energy minimization. A fold may occur at the secondary or tertiary level of the folding process. Examples of secondary level folds include beta sheets and alpha helices Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to proteins the term "loop" refers to a structural feature of a peptide or polypeptide which reverses the direction of the backbone of a peptide or polypeptide and comprises four or more amino acid residues. Oliva et al. have identified at least 5 classes of protein loops (J. Mol Biol 266 (4): 814-830: 1997).

As used herein when referring to proteins the term "half-loop" refers to a portion of an identified loop having at least half the number of amino acid residues as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to proteins the term "domain" refers to a motif of a polypeptide having one or more identifiable structural or functional characteristics or properties (e.g., binding capacity, serving as a site for protein-protein interactions).

As used herein when referring to proteins the term "half-domain" means portion of an identified domain having at least half the number of amino acid residues as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the poly peptide (i.e., nonadjacent amino acids may fold structurally to produce a domain, half-domain or subdomain).

As used herein when referring to proteins the terms "site" as it pertains to amino acid based embodiments is used synonymous with "amino acid residue" and "amino acid side chain". A site represents a position within a peptide or polypeptide that may be modified, manipulated, altered, derivatized or varied within the polypeptide based molecules of the present invention.

As used herein the terms "termini or terminus" when referring to proteins refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a component of a molecule of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involves deleting a domain would result in the alteration of the length of a molecule just as modification of a nucleic acid to encode less than a full-length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

AAV Production

The present invention provides methods for the generation of parvoviral particles, e.g. AAV particles, by viral genome replication in a viral replication cell.

In accordance with the invention, the viral genome comprising a payload region encoding an antibody, an antibody-based composition or fragment thereof, will be incorporated into the AAV particle produced in the viral replication cell. Methods of making AAV particles are well known in the art and are described in e.g., U.S. Pat. Nos. 6,204,059, 5,756,283, 6,258,595, 6,261,551, 6,270,996, 6,281,10, 6,365,394, 6,475,769, 6,482,634, 6,4859,669, 6,943,01, 6,953,690, 7,022,519, 7,238,526, 7,291,498 and 7,491,508, 5,064,764, 6,194,191, 6,566,118, 8,137,948, or International Publication Nos. WO1996039530, WO1998010088, WO999014354, WO1999015685, WO1999047691, WO2000055342, WO2000075353 and WO2001023597; Methods In Molecular Biology, ed. Richard, Humana Press, N J (1995); O'Reilly et al., Baculovirus Expression Vectors, A Laboratory Manual. Oxford Univ. Press (1994); Samulski et al., *J. Vir.* 63:3822-8 (1989); Kajigaya et al., *Proc. Nat'l. Acad. Sci. USA* 88: 4646-50 (1991); Ruffing et al., *J. Vir.* 66:6922-30 (1992); Kimbauer et al., *Vir.* 219:37-44 (1996); Zhao et al., *Vir.* 272:382-93 (2000); the contents of each of which are herein incorporated by reference in their entirety. In one embodiment, the AAV particles are made using the methods described in WO2015191508, the contents of which are herein incorporated by reference in their entirety.

Viral replication cells commonly used for production of recombinant AAV viral vectors include but are not limited to 293 cells, COS cells. HeLa cells, KB cells, and other mammalian cell lines as described in U.S. Pat. Nos. 6,156,303, 5,387,484, 5,741,683, 5,691,176, and 5,688,676; U.S. patent publication No. 2002/0081721, and International Patent Publication Nos. WO 00/47757, WO 00/24916, and WO 96/17947, the contents of each of which are herein incorporated by reference in their entireties.

In some embodiments, the present invention provides a method for producing an AAV particle having enhanced (increased, improved) transduction efficiency comprising the steps of: 1) co-transfecting competent bacterial cells with a bacmid vector and either a viral construct vector and/or AAV payload construct vector, 2) isolating the resultant viral construct expression vector and AAV payload construct expression vector and separately transfecting viral replication cells, 3) isolating and purifying resultant payload and viral construct particles comprising viral construct expression vector or AAV payload construct expression vector, 4) co-infecting a viral replication cell with both the AAV payload and viral construct particles comprising viral construct expression vector or AAV payload construct expression vector, and 5) harvesting and purifying the AAV particle comprising a viral genome.

In some embodiments, the present invention provides a method for producing an AAV particle comprising the steps of 1) simultaneously co-transfecting mammalian cells, such as, but not limited to HEK293 cells, with a pay load region, a construct expressing rep and cap genes and a helper construct, 2) harvesting and purifying the AAV particle comprising a viral genome.

In some embodiments, the viral genome of the AAV particle of the invention optionally encodes a selectable marker. The selectable marker may comprise a cell-surface marker, such as any protein expressed on the surface of the cell including, but not limited to receptors. CD markers, lectins, integrins, or truncated versions thereof.

In some embodiments, selectable marker reporter genes as described in International application No WO 96/23810, Heim et al, Current Biology 2:178-182 (1996); Heim et al., Proc. Natl. Acad. Sci. USA (1995); or Heim et al., Science 373:663-664 (1995); WO 96/30540, the contents of each of which are incorporated herein by reference in their entireties).

II. Formulation and Delivery

Pharmaceutical Compositions

According to the present invention the AAV particles may be prepared as pharmaceutical compositions. It will be understood that such compositions necessarily comprise one or more active ingredients and, most often, a pharmaceutically acceptable excipient.

Relative amounts of the active ingredient (e.g. AAV particle), a pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 5 and 50%, between 1-30%, between 5-80%, at least 80% (w/w) active ingredient.

In some embodiments, the AAV particle pharmaceutical compositions described herein may comprise at least one pa load. As a non-limiting example, the pharmaceutical compositions may contain an AAV particle with 1, 2, 3, 4 or 5 payloads. In one embodiment, the pharmaceutical composition may contain a nucleic acid encoding a payload construct encoding proteins selected from antibodies and/or antibody-based compositions.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, rats, birds, including commercially relevant birds such as poultry, chickens, ducks, geese, and/or turkeys.

In some embodiments, compositions are administered to humans, human patients or subjects.

Formulations

The AAV particles of the invention can be formulated using one or more excipients to: (1) increase stability; (2) increase cell transfection or transduction; (3) permit the sustained or delayed expression of the payload; (4) alter the biodistribution (e.g., target the viral particle to specific tissues or cell types); (5) increase the translation of encoded protein; (6) alter the release profile of encoded protein and/or (7) allow for regulatable expression of the payload.

Formulations of the present invention can include, without limitation, saline, liposomes, lipid nanoparticles, polymers, peptides, proteins, cells transfected with viral vectors (e.g., for transfer or transplantation into a subject) and combinations thereof.

Formulations of the pharmaceutical compositions described herein may be prepared by any method known or hereafter developed in the art of pharmacology. As used herein the term "pharmaceutical composition" refers to compositions comprising at least one active ingredient and optionally one or more pharmaceutically acceptable excipients.

In general, such preparatory methods include the step of associating the active ingredient with an excipient and/or one or more other accessory ingredients. As used herein, the phrase "active ingredient" generally refers either to an AAV particle carrying a payload region encoding the polypeptides of the invention or to the antibody or antibody-based composition encoded by a viral genome of by an AAV particle as described herein.

Formulations of the AAV particles and pharmaceutical compositions described herein may be prepared by any method known or hereafter developed in the art of pharmacology. In general, such preparatory methods include the step of bringing the active ingredient into association with an excipient and/or one or more other accessor ingredients, and then, if necessary and/or desirable, dividing, shaping and/or packaging the product into a desired single- or multi-dose unit.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

In one embodiment, the AAV particles of the invention may be formulated in PBS with 0.001% of pluronic acid (F-68) at a pH of about 7.0.

Relative amounts of the active ingredient (e.g. AAV particle), the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the AAV formulations described herein may contain sufficient AAV particles for expression of at least one expressed functional antibody or antibody-based composition. As a non-limiting example, the AAV particles may contain viral genomes encoding 1, 2, 3, 4 or 5 functional antibodies.

According to the present invention AAV particles may be formulated for CNS delivery. Agents that cross the brain blood barrier may be used. For example, some cell penetrating peptides that can target molecules to the brain blood barrier endothelium may be used for formulation (e.g., Mathupala, *Expert Opin Ther Pat.*, 2009, 19, 137-140; the content of which is incorporated herein by reference in its entirety).

Excipients and Diluents

The AAV particles of the invention can be formulated using one or more excipients or diluents to (1) increase stability; (2) increase cell transfection or transduction; (3) permit the sustained or delayed release; (4) alter the biodistribution (e.g. target the viral particle to specific tissues or cell types); (5) increase the translation of encoded protein in vivo; (6) alter the release profile of encoded protein in vivo and/or (7) allow for regulatable expression of the polypeptides of the invention.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Excipients, as used herein, include, but are not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21st Edition, A R Gennaro. Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Inactive Ingredients

In some embodiments, AAV particle formulations may comprise at least one inactive ingredient. As used herein, the term "inactive ingredient" refers to one or more agents that do not contribute to the activity of the active ingredient of the pharmaceutical composition included in formulations. In some embodiments, all, none or some of the inactive ingredients which may be used in the formulations of the present invention may be approved by the US Food and Drug Administration (FDA).

In one embodiment, the AAV particle pharmaceutical compositions comprise at least one inactive ingredient such as, but not limited to, 1,2,6-Hexanetriol; 1,2-Dimyristoyl-Sn-Glycero-3-(Phospho-S-(1-Glycerol)); 1,2-Dilmyristoyl-Sn-Glycero-3-Phospho choline; 1,2-Dioleoyl-Sn-Glycero-3-Phosphocholine; 1,2-Dialmitoyl-Sn-Glycero-3-(Phospho-Rac-(1-Glycerol)); 1,2-Distearyl-Sn-Glycero-3-(Phospho-Rac-(1-Glycerol)); 1,2-Distearoyl-Sn-Glycero-3-Phosphocholine; 1-O-Tolylbiguanide; 2-Ethyl-1,6-Hexanediol; Acetic Acid; Acetic Acid, Glacial; Acetic Anhydride; Acetone, Acetone Sodium Bisulfite; Acetylated Lanolin Alcohols; Acetylated Monoglycerides; Acetylcysteine; Acetyltryptophan. DL-; Acrylates Copolymer; Acrylic Acid-Isooctyl Acrylate Copolymer; Acrylic Adhesive 788; Activated Charcoal; Adcote 72A103; Adhesive Tape; Adipic Acid; Aerotex Resin 3730; Alanine; Albumin Aggregated; Albumin Colloidal, Albumin Human, Alcohol, Alcohol, Dehydrated; Alcohol, Denatured; Alcohol; Diluted; Alfadex; Alginic Acid; Alkyl Ammonium Sulfonic Acid Betaine; Alkyl Aryl Sodium Sulfonate; Allantoin; Allyl .Alpha-Ionone; Almond Oil; Alpha-Terpineol; Alpha-Tocopherol; Alpha-Tocopherol Acetate; Dl-; Alpha-Tocopherol; Dl-; Aluminum Acetate; Aluminum Chlorhydroxy Allantoinate; Aluminum Hydroxide; Aluminum Hydroxide-Sucrose; Hydrated; Aluminum Hydroxide Gel; Aluminum Hydroxide Gel F 500; Aluminum Hydroxide Gel F 5000; Aluminum Monostearate; Aluminum Oxide; Aluminum Polyester; Aluminum Silicate; Aluminum Starch Octenylsuccinate; Aluminum Stearate; Aluminum Subacetate; Aluminum Sulfate Anhydrous; Amerchol C; Amerchol-Cab; Aminomethylpropanol; Ammonia; Ammonia Solution; Ammonia Solution; Strong; Ammonium Acetate; Ammonium Hydroxide; Ammonium Lauryl Sulfate; Ammonium Nonoxynol-4 Sulfate; Ammonium Salt Of C-12-C-15 Linear Primary Alcohol Ethoxylate; Ammonium Sulfate; Ammonyx; Amphoteric-2; Amphoteric-9; Anethole; Anhydrous Citric Acid; Anhydrous Dextrose; Anhydrous Lactose; Anhydrous Trisodium Citrate; Aniseed Oil; Anoxid Sbn; Antifoam; Antipyrine; Apaflurane; Apricot Kernel Oil Peg-6 Esters; Aquaphor; Arginine; Arlacel; Ascorbic Acid; Ascorbyl Palmitate; Aspartic Acid; Balsam Peru; Barium Sulfate; Beeswax; Beeswax; Synthetic; Beheneth-10; Bentonite; Benzalkonium Chloride; Benzenesulfonic Acid; Benzethonium Chloride; Benzododecinium Bromide; Benzoic Acid; Benzyl Alcohol; Benzyl Benzoate; Benzyl Chloride; Betadex; Bibapcitide; Bismuth Subgallate; Boric Acid; Brocrinat; Butane; Butyl Alcohol; Butyl Ester Of Vinyl Methyl Ether/Maleic Anhydride Copolymer (125000) Mw); Butyl Stearate; Butylated Hydroxyanisole; Butylated Hydroxytoluene; Butylene Glycol; Butylparaben; Butyric Acid; C20-40 Pareth-24; Caffeine; Calcium; Calcium Carbonate; Calcium Chloride; Calcium Gluceptate; Calcium Hydroxide; Calcium Lactate; Calcobutrol; Caldiamide Sodium; Caloxetate Trisodium; Calteridol Calcium; Canada Balsam; Caprylic/Capric Triglyceride; Caprylic/Capric/Stearic Triglyceride; Captan; Captisol; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythrtol Crosslinked); Carbomer Homopolymer Type C (Allyl Pentaerythritol Crosslinked); Carbon Dioxide; Carboxy Vinyl Copolymer; Carboxymethylcellulose; Carboxymethylcellulose Sodium; Carboxypolymethylene; Carrageenan; Carrageenan Salt; Castor Oil; Cedar Leaf Oil; Cellulose; Cellulose; Microcrystalline; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20; Ceteth-23; Cetostearyl Alcohol; Cetrimonium Chloride; Cetyl Alcohol; Cetyl Esters Wax; Cetyl Palmitate; Cetylpyridinium Chloride; Chlorobutanol; Chlorobutanol H-Hhemihydrate; Chlorobutanol; Anhydrous; Chlorocresol; Chloroxylenol; Cholesterol; Choleth; Choleth-24; Citrate; Citric Acid; Citric Acid Monohydrate; Citric Acid, Hydrous. Cocamide Ether Sulfate; Cocamine Oxide; Coco Betaine; Coco Diethanolamide; Coco Monoethanolamide, Cocoa Butter; Coco-Glycerides; Coconut Oil; Coconut Oil; Hydrogenated; Coconut Oil/Palm Kernel Oil Glycerides, Hydrogenated; Cocoyl Caprylocaprate; Cola Nitida Seed Extract; Collagen; Coloring Suspension, Corn Oil. Cottonseed Oil; Cream Base; Creatine; Creatinine; Cresol; Croscarmellose Sodium; Crospovidone; Cupric Sulfate, Cupric Sulfate Anhydrous; Cyclomethicone; Cyclomethicone/Dimethicone Copolyol; Cysteine; Cysteine Hydrochloride; Cysteine Hydrochloride Anhydrous; Cysteine, D1-; D&C Red No. 28; D&C Red No. 33; D&C Red No. 36; D&C Red No. 39, D&C Yellow No. 10; Dalfampridine; Daubert 1-5 Pestr (Matte) 164z; Decyl Methyl Sulfoxide; Dehydag Wax Sx; Dehydroacetic Acid; Dehymuls E; Denatonium Benzoate; Deoxycholic Acid; Dextran; Dextran 40; Dextrin; Dextrose; Dextrose Monohydrate, Dextrose Solution; Diatrizoic Acid; Diazolidinyl Urea; Dichlorobenzl Alcohol; Dichlorodifluoromethane; Dichlorotetrafluoroethane; Diethanolamine, Diethyl Pyrocarbonate; Diethyl Sebacate; Diethylene Glycol Monoethyl Ether; Diethylhexyl Phthalate; Dihydroxyaluminum Aminoacetate; Diisopropanolamine; Diisopropyl Adipate; Diisopropyl Dilinoleate, Dimethicone 350; Dimethicone Copolyol; Dimethicone Mdx4-4210; Dimethicone Medical Fluid 360; Dimethyl Isosorbide; Dimethyl Sulfoxide; Dimethylaminoethyl Methacrylate-Butyl Methacrylate—Methyl Methacrylate Copolymer; Dimethyldioctadecylammonium Bentonite; Dimethylsiloxane/Methylvinylsiloxane Copolymer; Dinoseb Ammonium Salt; Dipalmitoylphosphatidylglycerol, Dl-; Dipropylene Glycol; Disodium Cocoamphodiacetate; Disodium Laureth Sulfosuccinate; Disodium Lauryl Sulfosuccinate; Disodium Sulfosalicylate; Disofenin; Divinylbenzene Styrene Copolymer; Dmdm Hydantoin; Docosanol; Docusate Sodium, Duro-Tak 280-2516; Duro-Tak 387-2516; Duro-Tak 80-1196, Duro-Tak 87-2070; Duro-Tak 87-2194; Duro-Tak 87-2287; Duro-Tak 87-2296; Duro-Tak 87-2888; Duro-Tak 87-2979; Edetate Calcium Disodium; Edetate Disodium; Edetate Disodium Anhydrous; Edetate Sodium; Edetic Acid; Egg Phospholipids, Entsufon; Entsufon Sodium; Epilactose; Epitetracycline Hydrochloride; Essence Bouquet 9200; Ethanolamine Hydrochloride, Ethyl Acetate; Ethyl Oleate; Ethylcelluloses; Ethylene Glycol; Ethylene Vinyl Acetate Copolymer; Ethylenediamrne; Ethylenediamrne Dihydrochloride. Ethylene-Propylene Copolymer; Ethylene-Vinyl Acetate Copolymer (28% Vinyl Acetate), Ethylene-Vinyl Acetate Copolymer (9% Vinylacetate); Ethylhexyl Hydroxystearate; Ethylparaben; Eucalyptol; Exametazime; Fat, Edible; Fat, Hard; Fatty Acid Esters; Fatty Acid Pentaerythriol Ester; Fatty Acids; Fatty Alcohol Citrate; Fatty Alcohols; Fd&C Blue No. 1; Fd&C Green No. 3; Fd&C Red No. 4; Fd&C Red No. 40; Fd&C Yellow No. 10 (Delisted); Fd&C Yellow No 5; Fd&C Yellow No 6; Ferric Chloride; Ferric Oxide; Flavor 89-186; Flavor 89-259. Flavor Df-119; Flavor Df-1530; Flavor Enhancer; Flavor Fig 827118; Flavor Raspberry Pfc-8407; Flavor Rhodia Pharmaceutical No. Rf 451; Fluorochlorohydrocarbons; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124. Fragrance Bouquet 10328; Fragrance Chemoderm 6401-B; Fragrance Chemoderm 6411, Fragrance Cream No. 73457, Fragrance Cs-28197; Fragrance Felton 066m; Fragrance Firmenich 47373; Fragrance Givaudan Ess 9090/1c; Fragrance H-6540; Fragrance Herbal 10396, Fragrance Nj-1085; Fragrance PO Fl-147. Fragrance Pa 52805; Fragrance Pera Derm D, Fragrance Rbd-9819; Fragrance Shaw Mudge U-7776; Fragrance Tf 044078; Fragrance Ungerer Honeysuckle K 2771; Fragrance Ungerer N5195; Fructose; Gadolinium Oxide; Galactose; Gamma Cyclodextrin; Gelatin; Gelatin, Crosslinked; Gelfoam Sponge; Gellan Gum (Low Acyl); Gelva 737; Gentisic Acid; Gentisic Acid Ethanolamide, Gluceptate Sodium; Gluceptate Sodium Dihydrate; Gluconolactone, Glucuronic Acid; Glutamic Acid; D1-; Glutathione; Glycerin; Glycerol Ester Of Hydrogenated Rosin; Glyceryl Citrate; Glyceryl Isostearate, Glyceryl Laurate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate-Laureth-23; Glyceryl Stearate/Peg Stearate; Glyceryl Stearate/Peg-100 Stearate; Glyceryl Stearate/Peg-40 Stearate; Glyceryl Stearate-Stearamidoethyl Diethylamine; Glyceryl Trioleate; Glycine; Glycine Hydrochloride; Glycol Distearate; Glycol Stearate; Guanidine Hydrochloride; Guar Gum; Hair Conditioner (18n195-1m); Heptane, Hetastarch; Hexylene Glycol; High Density Polyethylene; Histidine; Human Albumin Microspheres; Hyaluronate Sodium; Hydrocarbon; Hydrocarbon Gel, Plasticized; Hydrochloric Acid; Hydrochloric Acid, Diluted; Hydrocortisone; Hydrogel Polymer; Hydrogen Peroxide; Hydrogenated Castor Oil; Hydrogenated Palm Oil; Hydrogenated Palm/Palm Kernel Oil Peg-6 Esters; Hydrogenated Polybutene 635-690; Hydroxide Ion; Hydroxyethyl Cellulose; Hydroxyethylpiperazine Ethane Sulfonic Acid; Hydroxymethyl Cellulose; Hydroxyoctacosanyl Hydroxystearate; Hydroxypropyl Cellulose; Hydroxypropyl Methylcellulose 2906; Hydroxypropyl-Beta-cyclodextrn; Hypromellose 2208 (15000 Mpa S); Hypromellose 2910 (1500 Mpa·S); Hypromellose; Imidurea; Iodine; Iodoxamic Acid; Iofetamine Hydrochloride; Irish Moss Extract; Isobutane; Isoceteth-20; Isoleucine; Isooctyl Acrylate; Isopropyl Alcohol; Isopropyl Isostearate; Isopropyl Myristate; Isopropyl Myristate-Myristyl Alcohol; Isopropyl Palmatate; Isopropyl Stearate; Isostearic Acid; Isostearyl Alcohol; Isotonic Sodium Chloride Solution; Jelene, Kaolin; Kathon Cg; Kathon Cg II, Lactate; Lactic Acid; Lactic Acid. Dl-; Lactic Acid. L-; Lactobionic Acid; Lactose; Lactose Monohydrate; Lactose, Hydrous, Laneth; Lanolin, Lanolin Alcohol-Mineral Oil; Lanolin Alcohols; Lanolin Anhydrous; Lanolin Cholesterols; Lanolin Nonionic Derivatives; Lanolin, Ethoxylated; Lanolin, Hydrogenated, Lauralkonium Chloride; Lauramine Oxide; Laurdimonium Hydrolyzed Animal Collagen; Laureth Sulfate; Laureth-2; Laureth-23; Laureth-4; Lauric Diethanolamide; Lauric Myristic Diethanolamide; Lauroyl Sarcosine; Lauryl Lactate; Lauryl Sulfate; Lavandula Angustifolia Flowering Top; Lecithin; Lecithin Unbleached; Lecithin, Egg; Lecithin, Hydrogenated; Lecithin, Hydrogenated Soy; Lecithin, Soybean; Lemon Oil; Leucine; Levulinic Acid; Lidofenin; Light Mineral Oil; Light Mineral Oil (85 Ssu); Limonene, (+/−)-; Lipocol Sc-15; Lysine. Lysine Acetate; Lysine Monohydrate, Magnesium Aluminum Silicate, Magnesium Aluminum Silicate Hydrate; Magnesium Chloride; Magnesium Nitrate; Magnesium Stearate; Maleic Acid; Mannitol; Maprofix; Mebrofenin; Medical Adhesive Modified S-15; Medical Antiform A-F Emulsion. Medronate Disodium; Medronic Acid. Meglumine; Menthol; Metacresol; Metaphosphoric Acid; Methanesulfonic Acid, Methionine; Methyl Alcohol; Methyl Gluceth-10; Methyl Gluceth-20; Methyl Gluceth-20 Sesquistearate; Methyl Glucose Sesquistearate; Methyl Laurate; Methyl Pyrrolidone; Methyl Salicylate; Methyl Stearate; Methylboronic Acid; Methylcellulose (4000 Mpa·S); Methylcelluloses; Methylchloroisothiazolinone; Methylene Blue, Methylisothiazolinone; Methylparaben; Microcrystalline Wax; Mineral Oil; Mono and Diglyceride; Monostearyl Citrate; Monothioglycerol; Multisterol Extract; Myristyl Alcohol; Myristyl Lactate; Myristyl-.Gamma.-Picolinium Chloride, N-(Carbamoyl-Methoxy Peg-40)-1,2-Distearoyl-Cephalin Sodium; N,N-Dimethylacetamide; Niacinamide, Nioxime; Nitric Acid; Nitrogen; Nonoxynol Iodine; Nonoxynol-15; Nonoxynol-9; Norflurane; Oatmeal; Octadecene-1/Maleic Acid Copolymer; Octanoic Acid; Octisalate; Octoxynol-1; Octoxynol-40, Octoxynol-9. Octyldodecanol, Octylphenol Polymethylene, Oleic Acid; Oleth-10/Oleth-5; Oleth-2; Oleth-20; Oleyl Alcohol; Oleyl Oleate; Olive Oil; Oxidronate Disodium; Oxyquinoline; Palm Kernel Oil; Palmitamine Oxide; Parabens; Paraffin; Paraffin, White Soft; Parfum Creme 45/3; Peanut Oil; Peanut Oil, Refined. Pectin; Peg 6-32 Stearate/Glycol Stearate; Peg Vegetable Oil; Peg-100 Stearate; Peg-12 Glyceryl Laurate; Peg-120 Glyceryl Stearate; Peg-120 Methyl Glucose Dioleate; Peg-15 Cocanmine; Peg-150 Distearate; Peg-2 Stearate; Peg-20 Sorbitan Isostearate; Peg-22 Methyl Ether/Dodecyl Glycol Copolymer; Peg-25 Propylene Glycol Stearate; Peg-4 Dilaurate; Peg-4 Laurate, Peg-40 Castor Oil; Peg-40 Sorbitan Diisostearate; Peg-45/Dodecyl Glycol Copolymer; Peg-5 Oleate; Peg-50 Stearate; Peg-54 Hydrogenated Castor Oil; Peg-6 Isostearate; Peg-60 Castor Oil; Peg-60 Hydrogenated Castor Oil; Peg-7 Methyl Ether; Peg-75 Lanolin; Peg-8 Laurate; Peg-8 Stearate, Pegoxol 7 Stearate; Pentadecalactone; Pentaerythrtol Cocoate; Pentasodium Pentetate, Pentetate Calcium Trisodium, Pentetic Acid, Peppermint Oil; Perflutren; Perfume 25677; Perfume Bouquet, Perfume E-1991; Perfume Gd 5604; Perfume Tana 90/42 Scba; Perfume W-1952-1, Petrolatum, Petrolatum; White; Petroleum Distillates; Phenol; Phenol; Liquefied; Phenonip; Phenoxyethanol; Phenylalanine; Phenylethyl Alcohol; Phenylmercuric Acetate; Phenylmercuric Nitrate; Phosphatidyl Glycerol; Egg; Phospholipid; Phospholipid, Egg; Phospholipon 90g; Phosphoric Acid, Pine Needle Oil (*Pinus Sylvestris*); Piperazine Hexahydrate; Plastibase-50w; Polacrilin; Polidronium Chloride, Poloxamer 124; Poloxamer 181; Poloxamer 182; Poloxamer 188; Poloxamer 237; Poloxamer 407; Poly(Bis(P-Carboxyphenoxy)Propane Anhydride); Sebacic Acid; Poly(Dimethylsiloxane/Methylvinylsiloxane/Methylhydrogensiloxane) Dimethylvinyl Or Dimethylhydroxy Or Trimethyl Endblocked; Poly(Dl-Lactic-Co-Glycolic Acid), (50:50; Poly (Dl-Lactic-Co-Glycolic Acid), Ethyl Ester Terminated; (50:50; Polyacrylic Acid (250000 Mw); Polybutene (1400 Mw); Polycarbophil; Polyester; Polyester Pol amine Copolymer; Polyester Rayon, Polyethylene Glycol 1000; Polyethylene Glycol 1450; Polyethylene Glycol 1500); Polyethylene Glycol 1540; Polyethylene Glycol 200; Polyethylene Glycol 300; Polyethylene Glycol 300-1600, Polyethylene Glycol 3350; Polyethylene Glycol 400; Polyethylene Glycol 4000; Polyethylene Glycol 540; Polyethylene Glycol 600; Polyethylene Glycol 6000; Polyethylene Glycol 8000; Polyethylene Glycol 900; Polyethylene High Density Containing Ferric Oxide Black (<1%); Polyethylene Low Density Containing Barium Sulfate (20-24%); Polyethylene T; Polyethylene Terephthalates; Polyglactin; Polyglyceryl-3 Oleate; Polyglyceryl-4 Oleate, Ppolyhydroxyethyl Methacrylate, Polyisobutylene, Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polylactide; Polyols, Polyoxyethylene Polyoxypropylene 1800; Polyoxyethylene Alcohols; Polyoxyethylene Fatty Acid Esters; Polyoxyethylene Propylene; Polyoxyl 20 Cetostearyl Ether; Polyoxyl 35 Castor Oil; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate, Polyoxyl Lanolin; Polyoxyl Palmitate; Polyoxyl Stearate; Polypropylene; Polypropylene Glycol; Polyquarternium-10; Polyquarternium-7 (70/30 Acrylamide/Dadmac; Polysiloxane; Polysorbate 20; Polysorbate 40; Polysorbate 60, Polysorbate 65, Polysorbate 80; Polyurethane; Polyvinyl Acetate, Polyvinyl Alcohol; Polyvinyl Chloride; Polyvinyl Chloride-Polyvinyl Acetate Copolymer; Polyvinylpyridine; Poppy Seed Oil; Potash; Potassium Acetate; Potassium Alum; Potassium Bicarbonate; Potassium Bisulfate; Potassium Chloride; Potassium Citrate; Potassium Hydroxide; Potassium Metabisulfite; Potassium Phosphate, Dibasic; Potassium Phosphate, Monobasic; Potassium Soap; Potassium Sorbate; Povidone Acrylate Copolymer; Povidone Hydrogel; Povidone K17; Povidone K25; Povidone K29/32, Povidone K30, Povidone K90; Povidone K90f; Povidone/Eicosene Copolymer; Povidones; Ppg-12/Smdi Copolymer; Ppg-15 Stearyl Ether; Ppg-20 Methyl Glucose Ether Distearate; Ppg-26 Oleate; Product Wat; Proline; Promulgen D; Promulgen G; Propane; Propellant A-46; Propyl Gallate; Propylene Carbonate; Propylene Glycol; Propylene Glycol Diacetate; Propylene Glycol Dicaprylate, Propylene Glycol Monolaurate; Propylene Glycol Monopalmitostearate; Propylene Glycol Palmitostearate; Propylene Glycol Ricinoleate; Propylene Glycol/Diazolidinyl Urea/Methylparaben/Propylparben; Propylparaben; Protamine Sulfate; Protein Hydrolysate, Pvm/Ma Copolymer; Quaternium-15; Quaternium-15 Cis-Form; Quaternium-52; Ra-2397; Ra-3011; Saccharin; Saccharin Sodium; Saccharin Sodium Anhydrous; Safflower Oil; Sd Alcohol 3a; Sd Alcohol 40; Sd Alcohol 40-2; Sd Alcohol 40b, Sepineo P600; Serine; Sesame Oil; Shea Butter, Silastic Brand Medical Grade Tubing; Silastic Medical Adhesive, Silicone Type A; Silica, Dental; Silicon; Silicon Dioxide; Silicon Dioxide, Colloidal; Silicone; Silicone Adhesive 4102; Silicone Adhesive 4502, Silicone Adhesive Bio-Psa Q7-4201; Silicone Adhesive Bio-Psa Q7-4301; Silicone Emulsion, Silicone/Polyester Film Strip; Simethicone; Simethicone Emulsion; Sipon Ls 20np; Soda Ash; Sodium Acetate; Sodium Acetate Anhydrous; Sodium Alkyl Sulfate; Sodium Ascorbate; Sodium Benzoate; Sodium Bicarbonate; Sodium Bisulfate; Sodium Bisulfite; Sodium Borate; Sodium Borate Decahydrate; Sodium Carbonate; Sodium Carbonate Decahydrate, Sodium Carbonate Monohydrate; Sodium Cetostearyl Sulfate, Sodium Chlorate, Sodium Chloride; Sodium Chloride Injection; Sodium Chloride Injection, Bacteriostatic; Sodium Cholesteryl Sulfate, Sodium Citrate; Sodium Cocoyl Sarcosinate; Sodium Desoxycholate; Sodium Dithionite; Sodium Dodecylbenzenesulfonate; Sodium Formaldehyde Sulfoxylate; Sodium Gluconate; Sodium Hydroxide; Sodium Hypochlorite; Sodium Iodide; Sodium Lactate; Sodium Lactate, L-; Sodium Laureth-2 Sulfate; Sodium Laureth-3 Sulfate; Sodium Laureth-5 Sulfate; Sodium Lauroyl Sarcosinate, Sodium Lauryl Sulfate; Sodium Lauryl Sulfoacetate; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic; Dihydrate; Sodium Phosphate, Dibasic, Dodecahydrate; Sodium Phosphate, Dibasic, Heptahydrate; Sodium Phosphate, Monobasic; Sodium Phosphate; Monobasic; Anhydrous, Sodium Phosphate, Monobasic; Dihydrate; Sodium Phosphate, Monobasic; Monohydrate; Sodium Polyacrylate (2500000 Mw); Sodium Pyrophosphate; Sodium Pyrrolidone Carboxylate; Sodium Starch Glycolate; Sodium Succinate Hexahydrate; Sodium Sulfate; Sodium Sulfate Anhydrous; Sodium Sulfate Decahydrate; Sodium Sulfite; Sodium Sulfosuccinated Undecyclenic Monoalkylolamide; Sodium Tartrate; Sodium Thioglycolate; Sodium Thiomalate, Sodium Thiosulfate; Sodium Thiosulfate Anhydrous; Sodium Trimetaphosphate, Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Trioleate; Sorbitan Tristearate; Sorbitol; Sorbitol Solution, Soybean Flour; Soybean Oil; Spearmint Oil, Spermaceti; Squalane; Stabilized Oxychloro Complex; Stannous 2-Ethylhexanoate; Stannous Chloride; Stannous Chloride Anhydrous; Stannous Fluoride; Stannous Tartrate; Starch; Starch 1500; Pregelatinized; Starch, Corn; Stearalkoniun Chloride; Stearalkonium Hectorite/Propylene Carbonate; Stearamidoethyl Diethylamine; Steareth-10, Steareth-100; Steareth-2; Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Sterile Water For Inhalation; Styrene/Isoprene/Styrene Block Copolymer; Succimer; Succinic Acid; Sucralose; Sucrose; Sucrose Distearate; Sucrose Polyesters; Sulfacetamide Sodium; Sulfobutylether .Beta.-Cyclodextrin; Sulfur Dioxide; Sulfuric Acid; Sulfurous Acid; Surfactol Qs; Tagatose, D-; Talc; Tall Oil; Tallow Glycerides; Tartaric Acid; Tartaric Acid; Dl-; Tenox; Tenox-2, Tert-Butyl Alcohol; Tert-Butyl Hydroperoxide; Tert-Butvlhydroquinone; Tetrakis(2-Methoxyisobutylisocyanide)Copper(I) Tetrafluoroborate; Tetrapropyl Orthosilicate; Tetrofosmin; Theophylline; Thimerosal; Threonine; Thymol; Tin; Titanium Dioxide; Tocopherol; Tocophersolan; Total parenteral nutrition, lipid emulsion; Triacetin; Tricaprylin; Trichloromonofluoromethane; Trideceth-10; Triethanolamine Lauryl Sulfate, Trifluoroacetic Acid; Triglycerides, Medium Chain; Trihydroxystearin; Trilaneth-4 Phosphate; Trilaureth-4 Phosphate, Trisodium Citrate Dihydrate; Trisodium Hedta; Triton 720; Triton X-200; Trolamine; Tromantadine; Tromethamine (TRIS); Typtophan; Tyloxapol; Tyrosine; Undecylenic Acid; Union 76 Amsco-Res 6038; Urea; Valine; Vegetable Oil; Vegetable Oil Glyceride, Hydrogenated; Vegetable Oil, Hydrogenated; Versetamide; Viscarin; Viscose/Cotton; Vitamin E; Wax, Emulsifying; Wecobee Fs; White Ceresin Wax; White Wax; Xanthan Gum; Zinc; Zinc Acetate; Zinc Carbonate; Zinc Chloride; and Zinc Oxide.

Pharmaceutical composition formulations of AAV particles disclosed herein may include cations or anions. In one embodiment, the formulations include metal cations such as, but not limited to, Zn2+, Ca2+, Cu2+, Mn2+, Mg+ and combinations thereof. As a non-limiting example, formulations may include polymers and complexes with a metal cation (See e.g., U.S. Pat. Nos. 6,265,389 and 6,555,525, each of which is herein incorporated by reference in its entirety).

Formulations of the invention may also include one or more pharmaceutically acceptable salts. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids.

Solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate"

III. Administration and Dosing

Administration

The AAV particles of the present invention may be administered by any delivery route which results in a therapeutically effective outcome. These include, but are not limited to, enteral (into the intestine), gastroenteral, epidural (into the dura mater), oral (by way of the mouth), transdermal, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intra-arterial (into an artery), intramuscular (into a muscle), intracardiac (into the heart), intraosseous infusion (into the bone marrow), intrathecal (into the spinal canal), intraparenchymal (into brain tissue), Intraperitoneal. (infusion or injection into the peritoneum), Intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), or in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

In some embodiments, compositions may be administered in a way which allows them to cross the blood-brain barrier, vascular barrier, or other epithelial barrier. The AAV particles of the present invention may be administered in any suitable form, either as a liquid solution or suspension, as a solid form suitable for liquid solution or suspension in a liquid solution. The AAV particles may be formulated with any appropriate and pharmaceutically acceptable excipient.

In one embodiment, the AAV particles of the present invention may be delivered to a subject, in a single route administration.

In one embodiment, the AAV particles of the present invention may be delivered to a subject via a multi-site route of administration. A subject may be administered at 2, 3, 4, 5 or more than 5 sites.

In one embodiment, a subject may be administered the AAV particles of the present invention using a bolus infusion.

In one embodiment, a subject may be administered the AAV particles of the present invention using sustained delivery over a period of minutes, hours or days. The infusion rate may be changed depending on the subject, distribution, formulation or another delivery parameter.

In one embodiment, the AAV particles of the present invention may be delivered by intramuscular delivery route. (See, e.g., U.S. Pat. No. 6,506,379, the content of which is incorporated herein by reference in its entirety). Non-limiting examples of intramuscular administration include an intravenous injection or a subcutaneous injection.

In one embodiment, the AAV particles of the present invention may be delivered by oral administration. Non-limiting examples of oral administration include a digestive tract administration and a buccal administration.

In one embodiment, the AAV particles of the present invention may be delivered by intraocular delivery route A non-limiting example of intraocular administration include an intravitreal injection.

In one embodiment, the AAV particles of the present invention may be delivered by intranasal delivery route. Non-limiting examples of intranasal delivery include administration of nasal drops or nasal sprays.

In some embodiments, the AAV particles that may be administered to a subject by peripheral injections. Non-limiting examples of peripheral injections include intraperitoneal, intramuscular, intravenous, conjunctival or joint injection. It was disclosed in the art that the peripheral administration of AAV vectors can be transported to the central nervous system, for example, to the motor neurons (e.g., U.S. Patent Publication Nos. 20100240739; and 20100130594; the content of each of which is incorporated herein by reference in their entirety).

In one embodiment, the AAV particles may be delivered by injection into the CSF pathway. Non-limiting examples of delivery to the CSF pathway include intrathecal and intracerebroventricular administration.

In one embodiment, the AAV particles may be delivered by systemic delivery. As a non-limiting example, the systemic delivery may be by intravascular administration.

In one embodiment, the AAV particles of the present invention may be administered to a subject by intracranial delivers' (See, e.g., U.S. Pat. No. 8,119,611; the content of which is incorporated herein by reference in its entirety).

In one embodiment, the AAV particles of the present invention may be administered to a subject by intraparenchymal administration.

In one embodiment, the AAV particles of the present invention may be administered to a subject by intramuscular administration.

In one embodiment, the AAV particles of the present invention are administered to a subject and transduce muscle of a subject. As a non-limiting example, the AAV particles are administered by intramuscular administration.

In one embodiment, the AAV particles of the present invention may be administered to a subject by intravenous administration.

In one embodiment, the AAV particles of the present invention may be administered to a subject by subcutaneous administration.

In one embodiment, the AAV particles of the present invention may be administered to a subject by topical administration.

In one embodiment, the AAV particles may be delivered by direct injection into the brain. As a non-limiting example, the brain delivery may be by intrastriatal administration.

In one embodiment, the AAV particles may be delivered by more than one route of administration. As non-limiting examples of combination administrations, AAV particles may be delivered by intrathecal and intracerebroventricular, or by intravenous and intraparenchymal administration.

Parenteral and Injectable Administration

In some embodiments, pharmaceutical compositions, AAV particles of the present invention may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P, and isotonic sodium chloride solution. Sterile, fixed oils are conventionally employed as a solvent or suspending medium. For this purpose, any bland fixed oil can be employed including synthetic mono- or diglycerides Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

In some embodiments, pharmaceutical compositions, AAV particles of the present invention may be administered rectally and/or vaginally Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

In some embodiments, pharmaceutical compositions, AAV particles of the present invention may be administered orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, pharmaceutical compositions, AAV particles of the present invention may be formulated for administration topically. The skin may be an ideal target site for delivery as it is readily accessible. Three routes are commonly considered to deliver pharmaceutical compositions, AAV particles of the present invention to the skin: (i) topical application (e.g. for local/regional treatment and/or cosmetic applications); (ii) intradermal injection (e.g. for local/regional treatment and/or cosmetic applications), and (iii) systemic delivery (e.g. for treatment of dermatologic diseases that affect both cutaneous and extracutaneous regions). Pharmaceutical compositions, AAV particles of the present invention can be delivered to the skin by several different approaches known in the art.

In some embodiments, the invention provides for a variety of dressings (e.g., wound dressings) or bandages (e.g., adhesive bandages) for conveniently and/or effectively carrying out methods of the present invention. Typically dressing or bandages may comprise sufficient amounts of pharmaceutical compositions, AAV particles of the present invention described herein to allow users to perform multiple treatments.

Dosage forms for topical and/or transdermal administration may include ointments, pastes, creams, lotions, gels, powders, solutions, sprays, inhalants and/or patches. Generally, active ingredients are admixed under sterile conditions with pharmaceutically acceptable excipients and/or any needed preservatives and/or buffers. Additionally, the present invention contemplates the use of transdermal patches, which often have the added advantage of providing controlled delivery of pharmaceutical compositions, AAV particles of the present invention to the body. Such dosage forms may be prepared, for example, by dissolving and/or dispensing pharmaceutical compositions, AAV particles in the proper medium. Alternatively, or additionally, rates may be controlled by either providing rate controlling membranes and/or by dispersing pharmaceutical compositions, AAV particles in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, pharmaceutical compositions, AAV particles of the present invention are formulated in depots for extended release. Generally, specific organs or tissues ("target tissues") are targeted for administration.

In some aspects of the invention, pharmaceutical compositions, AAV particles of the present invention are spatially retained within or proximal to target tissues. Provided are methods of providing pharmaceutical compositions, AAV particles, to target tissues of mammalian subjects by contacting target tissues (which comprise one or more target cells) with pharmaceutical compositions, AAV particles, under conditions such that they are substantially retained in target tissues, meaning that at least 10, 20, 30, 40, 50, 60, 70, 80, 85, 90, 95, 96, 97, 98, 99, 99.9, 99.99 or greater than 99.99% of the composition is retained in the target tissues. Advantageously, retention is determined by measuring the amount of pharmaceutical compositions, AAV particles, that enter one or more target cells. For example, at least 1%, 5%, 10%, 20%, 30%, 40%, 50%, 60%, 70%, 80%, 85%, 90%, 95%, 96%, 97%, 98%, 99%, 99.9%, 99.99% or greater than 99.99% of pharmaceutical compositions, AAV particles, administered to subjects are present intracellularly at a period of time following administration. For example, intramuscular injection to mammalian subjects may be performed using aqueous compositions comprising pharmaceutical compositions, AAV particles of the present invention and one or more transfection reagents, and retention is determined by measuring the amount of pharmaceutical compositions, AAV particles, present in muscle cells.

Certain aspects of the invention are directed to methods of providing pharmaceutical compositions, AAV particles of the present invention to a target tissues of mammalian subjects, by contacting target tissues (comprising one or more target cells) with pharmaceutical compositions, AAV particles under conditions such that they are substantially retained in such target tissues. Pharmaceutical compositions, AAV particles comprise enough active ingredient such that the effect of interest is produced in at least one target cell. In some embodiments, pharmaceutical compositions, AAV particles generally comprise one or more cell penetration agents, although "naked" formulations (such as without cell penetration agents or other agents) are also contemplated, with or without pharmaceutically acceptable carriers.

Pulmonary Administration

In some embodiments, pharmaceutical compositions, AAV particles of the present invention may be prepared, packaged, and/or sold in formulations suitable for pulmonary administration. In some embodiments, such administration is via the buccal cavity. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

In some embodiments, pharmaceutical compositions, AAV particles of the present invention may be administered nasally and/or intranasal. In some embodiments, formulations described herein useful for pulmonary delivery may also be useful for intranasal deliver. In some embodiments, formulations for intranasal administration comprise a coarse powder comprising the active ingredient and having an average particle from about 0.2 μm to 500 μm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein Ophthalmic or Otic Administration In some embodiments, pharmaceutical compositions, AAV particles of the present invention may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

Delivery to Cells

The present disclosure provides a method of delivering to a cell or tissue any of the above-described AAV particles, comprising contacting the cell or tissue with said AAV particle or contacting the cell or tissue with a formulation comprising said AAV particle, or contacting the cell or tissue with any of the described compositions, including pharmaceutical compositions. The method of delivering the AAV particle to a cell or tissue can be accomplished in vitro, ex vivo, or in vivo.

Delivery to Subjects

The present disclosure additionally provides a method of delivering to a subject, including a mammalian subject, any of the above-described AAV particles comprising administering to the subject said AAV particle, or administering to the subject a formulation comprising said AAV particle, or administering to the subject any of the described compositions, including pharmaceutical compositions.

Dose and Regimen

The present invention provides methods of administering AAV particles in accordance with the invention to a subject in need thereof. The pharmaceutical, diagnostic, or prophylactic AAV particles and compositions of the present invention may be administered to a subject using any amount and any route of administration effective for preventing, treating, managing, or diagnosing diseases, disorders and/or conditions. The exact amount required will vary from subject to subject, depending on the species, age, and general condition of the subject, the severity of the disease, the particular composition, its mode of administration, its mode of activity, and the like. The subject may be a human, a mammal, or an animal. Compositions in accordance with the invention are typically formulated in unit dosage form for ease of administration and uniformity of dosage. It will be understood, however, that the total daily usage of the compositions of the present invention may be decided by the attending physician within the scope of sound medical judgment. The specific therapeutically effective, prophylactically effective, or appropriate diagnostic dose level for any particular individual will depend upon a variety of factors including the disorder being treated and the severity of the disorder; the activity of the specific payload employed; the specific composition employed; the age, body weight, general health, sex and diet of the patient; the time of administration, route of administration, and rate of excretion of the specific AAV particle employed; the duration of the treatment; drugs used in combination or coincidental with the specific AAV particle employed; and like factors well known in the medical arts.

In certain embodiments, AAV particle pharmaceutical compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, or prophylactic, effect. It will be understood that the above dosing concentrations may be converted to vg or viral genomes per kg or into total viral genomes administered by one of skill in the art.

In certain embodiments, AAV particle pharmaceutical compositions in accordance with the present disclosure may be administered at about 10 to about 600 µl/site, 50 to about 500 µl/site, 100 to about 400 µl/site, 120 to about 300 µl/site, 140 to about 200 µl/site, about 160 µl/site. As non-limiting examples, AAV particles may be administered at 50 µl/site and/or 150 µl/site.

The desired dosage of the AAV particles of the present invention may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event.

The desired dosage of the AAV particles of the present invention may be administered as a "pulse dose" or as a "continuous flow" As used herein, a "pulse dose" is a series of single unit doses of any therapeutic administered with a set frequency over a period of time. As used herein, a "continuous flow" is a dose of therapeutic administered continuously for a period of time in a single route/single point of contact, i.e., continuous administration event. A total daily dose, an amount given or prescribed in 24 hour period, may be administered by any of these methods, or as a combination of these methods, or by any other methods suitable for a pharmaceutical administration.

In one embodiment, delivery of the AAV particles of the present invention to a subject provides neutralizing activity to a subject. The neutralizing activity can be for at least 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 20 months, 21 months, 22 months, 23 months, 2 years, 3 years, 4 years, 5 years, 6 years, 7 years, 8 years, 9 years, 10 years or more than 10 years.

In one embodiment, delivery, of the AAV particles of the present invention results in minimal serious adverse events (SAEs) as a result of the delivery of the AAV particles.

In one embodiment, delivery of AAV particles to cells of the central nervous system (e.g., parenchyma) may comprise a total dose between about $1 \times 10^6$ VG and about $1 \times 10^{16}$ VG, In some embodiments, delivery may comprise a total dose of about $1 \times 10^6$, $2 \times 10^6$, $3 \times 10^6$, $4 \times 10^6$, $5 \times 10^6$, $6 \times 10^6$, $7 \times 10^6$, $8 \times 10^6$, $9 \times 10^6$, $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $1.9 \times 10^{10}$, $2 \times 10^{10}$, $3 \times 10^{10}$, $3.73 \times 10^{10}$, $4 \times 10^{10}$, $5 \times 10^{10}$, $6 \times 10^{10}$, $7 \times 10^{10}$, $8 \times 10^{10}$, $9 \times 10^{10}$, $1 \times 10^{11}$, $2 \times 10^{11}$, $2.5 \times 10^{11}$, $3 \times 10^{11}$, $4 \times 10^{11}$, $5 \times 10^{11}$, $6 \times 10^{11}$, $7 \times 10^{11}$, $8 \times 10^{11}$, $9 \times 10^{11}$, $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, $9 \times 10^{12}$, $1 \times 10^{13}$, $2 \times 10^{13}$, $3 \times 10^{13}$, $4 \times 10^{13}$, $4 \times 10^{13}$, $6 \times 10^{13}$, $7 \times 10^{13}$, $8 \times 10^{13}$, $9 \times 10^{13}$, $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, $9 \times 10^{14}$, $1 \times 10^{15}$, $2 \times 10^{15}$, $3 \times 10^{15}$, $4 \times 10^{15}$, $5 \times 10^{15}$, $6 \times 10^{15}$, $7 \times 10^{15}$, $8 \times 10^{15}$, $9 \times 10^{15}$, or $1 \times 10^{16}$ VG. As a non-limiting example, the total dose is $1 \times 10^{13}$ VG. As another non-limiting example, the total dose is $2.1 \times 10^{12}$ VG.

In one embodiment, delivery of AAV particles to cells of the central nervous system (e.g., parenchyma) may comprise a composition concentration between about $1 \times 10^6$ VG/mL and about $1 \times 10^{16}$ VG/mL. In some embodiments, delivery may comprise a composition concentration of about $1 \times 10^6$, $2 \times 10^6$, $3 \times 10^6$, $4 \times 10^6$, $5 \times 10^6$, $6 \times 10^6$, $7 \times 10^6$, $8 \times 10^6$, $9 \times 10^6$, $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $2 \times 10^{10}$, $3 \times 10^{10}$, $4 \times 10^{10}$, $5 \times 10^{10}$, $6 \times 10^{10}$, $7 \times 10^{10}$, $8 \times 10^{10}$, $9 \times 10^{10}$, $1 \times 10^{11}$, $2 \times 10^{11}$, $3 \times 10^{11}$, $4 \times 10^{11}$, $5 \times 10^{11}$, $6 \times 10^{11}$, $7 \times 10^{11}$, $8 \times 10^{11}$, $9 \times 10^{11}$, $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, $9 \times 10^{12}$, $1 \times 10^{13}$, $2 \times 10^{13}$, $3 \times 10^{13}$, $4 \times 10^{13}$, $5 \times 10^{13}$, $6 \times 10^{13}$, $7 \times 10^{13}$, $8 \times 10^{13}$, $9 \times 10^{13}$, $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, $9 \times 10^{14}$, $1 \times 10^{15}$, $2 \times 10^{15}$, $3 \times 10^{15}$, $4 \times 10^{15}$, $5 \times 10^{15}$, $6 \times 10^{15}$, $7 \times 10^{15}$, $8 \times 10^{15}$, $9 \times 10^{15}$, or $1 \times 10^{16}$ VG/mL. In one embodiment, the delivery comprises a composition concentration of $1 \times 10^{13}$ VG/mL. In one embodiment, the delivery comprises a composition concentration of $2.1 \times 10^{12}$ VG/mL.

Combinations

The AAV particles may be used in combination with one or more other therapeutic, prophylactic, research or diagnostic agents. By "in combination with," it is not intended to imply that the agents must be administered at the same time and/or formulated for delivery together, although these methods of delivery are within the scope of the present invention. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, research, or diagnostic compositions in combination with agents that may improve their bioavailability, reduce and/or modify their metabolism, inhibit their excretion, and/or modify their distribution within the body.

Measurement of Expression

Expression of payloads from viral genomes may be determined using various methods known in the art such as, but not limited to immunochemistry (e.g., IHC), in situ hybridization (ISH), enzyme-linked immunosorbant assay (ELISA), affinity ELISA, ELISPOT, flow cytometry, immunocytology, surface plasmon resonance analysis, kinetic exclusion assay, liquid chromatography-mass spectrometry (LCMS), high-performance liquid chromatography (HPLC). BCA assay, immunoelectrophoresis. Western blot, SDS-PAGE, protein immunoprecipitation, and/or PCR, Bioavalability The AAV particles, when formulated into a composition with a delivery agent as described herein, can exhibit an increase in bioavailability as compared to a composition lacking a delivery agent as described herein. As used herein, the term "bioavailability" refers to the systemic availability of a given amount of AAV particle or expressed payload administered to a mammal. Bioavailability can be assessed by measuring the area under the curve (AUC) or the maximum serum or plasma concentration ($C_{max}$) of the composition following. AUC is a determination of the area under the curve plotting the serum or plasma concentration of a compound (e.g., AAV particles or expressed payloads) along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, the contents of which are herein incorporated by reference in its entirety.

The $C_{max}$ value is the maximum concentration of the AAV particle or expressed payload achieved in the serum or plasma of a mammal following administration of the AAV particle to the mammal. The $C_{max}$ value of can be measured using methods known to those of ordinary skill in the art. The phrases "increasing bioavailability" or "improving the pharmacokinetics," as used herein mean that the systemic availability of a first AAV particle or expressed payload, measured as AUC, $C_{max}$, or $C_{min}$ in a mammal is greater, when co-administered with a delivery agent as described herein, than when such co-administration does not take place. In some embodiments, the bioavailability can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Therapeutic Window

As used herein "therapeutic window" refers to the range of plasma concentrations, or the range of levels of therapeutically active substance at the site of action, with a high probability of eliciting a therapeutic effect. In some embodiments, the therapeutic window of the AAV particle as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

As used herein, the term "volume of distribution" refers to the fluid volume that would be required to contain the total amount of the drug in the body at the same concentration as in the blood or plasma: $V_{dist}$ equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, $V_{dist}$ can be used to determine a loading dose to achieve a steady state concentration. In some embodiments, the volume of distribution of the AAV particles as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the AAV particles delivered to the animals may be categorized by analyzing the payload expression in the animals. The payload expression may be determined from analyzing a biological sample collected from a mammal administered the AAV particles of the present invention. For example, a protein expression of 50-200 pg/ml for the protein encoded by the AAV particles delivered to the mammal may be seen as a therapeutically effective amount of protein in the mammal.

IV. Methods and Uses of the Compositions of the Invention

The present disclosure provides a method for treating a disease, disorder and/or condition in a mammalian subject, including a human subject, comprising administering to the subject any of the AAV particles described herein or administering to the subject any of the described compositions, including pharmaceutical compositions, described herein.

In one embodiment, the AAV particles of the present invention are administered to a subject prophylactically.

In one embodiment, the AAV particles of the present invention are administered to a subject having at least one of the diseases described herein.

In one embodiment, the AAV particles of the present invention are administered to a subject to treat a disease or disorder described herein. The subject may have the disease or disorder or may be at-risk to developing the disease or disorder.

In one embodiment, the AAV particles of the present invention are part of an active immunization strategy to protect against diseases and disorders. In an active immunization strategy, a vaccine or AAV particles are administered to a subject to prevent an infectious disease by activating the subject's production of antibodies that can fight off invading bacteria or viruses.

In one embodiment, the AAV particles of the present invention are part of a passive immunization strategy. In a passive immunization strategy, antibodies against a particular infectious agent are given directly to the subject.

Diseases and Toxins

Various infectious diseases may be treated with pharmaceutical compositions, AAV particles, of the present invention. As used herein, the term "infectious disease" refers to any disorders caused by organisms such as bacteria, viruses, fungi or parasites. As a non-limiting example, the infectious disease may be Acute bacterial rhinosinusitis, 14-day measles. Acne, Acrodermatitis chronica atrophicans (ACA)- (late skin manifestation of latent Lyme disease), Acute hemorrhagic conjunctivitis, Acute hemorrhagic cystitis, Acute rhinosinusitis, Adult T-cell Leukemia-Lymphoma (ATLL), African Sleeping Sickness, AIDS (Acquired Immunodeficiency Syndrome), Alveolar hydatid, Amebiasis, Amebic meningoencephalitis, Anaplasmosis, Anthrax, Arboviral or parainfectious, Ascariasis—(Roundworm infections), Aseptic meningitis, Athlete's foot (Tinea pedis), Australian tick typhus, Avian Influenza, Babesiosis, Bacillary angiomatosis, Bacterial meningitis, Bacterial vaginosis, Balanitis, Balantidiasis, Bang's disease, Barmah Forest virus infection, Bartonellosis (Verruga peruana; Carrion's disease; Oroya fever), Bat Lyssavirus Infection, Bay sore (Chiclero's ulcer), Baylisascaris infection (Racoon roundworm infection), Beaver fever, Beef tapeworm, Bejel (endemic syphilis), Biphasic meningoencephalitis, Black Bane, Black death, Black piedra, Blackwater Fever, Blastomycosis, Blennorrhea of the newborn, Blepharitis, Boils, Bomholm disease (pleurodynia), *Borrelia miyamotoi* Disease, Botulism, Boutonneuse fever, Brazilian purpuric fever, Break Bone fever, Brill, Bronchiolitis, Bronchitis, Brucellosis (Bang's disease), Bubonic plague, Bullous impetigo, *Burkholderia* mallei (Glanders), *Burkholderia pseudomallei* (Melioidosis), Buruli ulcers (also Mycoburuli ulcers), Busse Busse-Buschke disease (Cryptococcosis), California group encephalitis, Campylobacteriosis, Candidiasis, Canefield fever (Canicola fever; 7-day fever; Weil's disease; leptospirosis; canefield fever), Canicola fever, Capillanasis, Carate, Carbapenem-resistant Enterobacteriaceae (CRE), Carbuncle, Carrion's disease, Cat Scratch fever, Cave disease, Central Asian hemorrhagic fever, Central European tick, Cervical cancer, Chagas disease, Chancroid (Soft chancre), Chicago disease, Chickenpox (Varicella), Chiclero's ulcer, Chikungunya fever, Chlarmydial infection, Cholera, Chromoblastomycosis, Ciguatera, Clap, Clonorchiasis (Liver fluke infection), *Clostridium difficile* Infection, *Clostridium perfringens* (Epsilon Toxin), Coccidioidonycosis fungal infection (Valley fever; desert rheumatism), Coenurosis, Colorado tick fever, Condyloma accuminata, Condyloma accununata (Warts), Condyloma lata, Congo fever, Congo hemorrhagic fever virus, Conjunctivitis, cowpox, Crabs, Crimean, Croup, Cryptococcosis, Cryptosporidiosis (Crypto), Cutaneous Larval Migrans, Cyclosporiasis, Cystic hydatid, Cysticercosis, Cystatis, Czechoslovak tick, D68 (EV-D68), Dacryocytitis, Dandy fever, Darling's Disease, Deer fly fever, Dengue fever (1, 2, 3 and 4), Desert rheumatism, Devil's grip, Diphasic milk fever, Diphtheria, Disseminated Intravascular Coagulation, Dog tapeworm, Donovanosis, Donovanosis (Granuloma inguinale), Dracontiasis, Dracunculosis, Duke's disease, Dum Dum Disease, Durand-Nicholas-Favre disease, Dwarf tapeworm, *E, Coli* infection (*E. Coli*), Eastern equine encephalitis, Ebola Hemorrhagic Fever (Ebola virus disease EVD), Ectothrix, Ehrlichiosis (Sennetsu fever), Encephalitis, Endemic Relapsing fever, Endemic syphilis, Endophthalmitis, Endothrix, Enterobiasis (Pinworm infection), Enterotoxin-B Poisoning (Staph Food Poisoning), Enterovirus Infection, Epidemic Keratoconjunctivitis, Epidemic Relapsing fever, Epidemic typhus, Epiglottitis, Erysipelis, Ervsipeloid (Erysipelothricosis), Erythema chronicum migrans, Erythema infectiosum, Erythema marginatum, Enrthema multiforme, Erythema nodosum, Erythema nodosum leprosum Erythrasma, Espundia, Euniycotic mycetoma, European blastomycosis, Exanthem subitumn (Sixth disease), Eyeworm, Far Eastern tick, Fascioliasis, Fievre boutonneuse (Tick typhus), Fifth Disease (erythema infectiosum), Filatow-Dukes' Disease (Scalded Skin Syndrome; Ritter's Disease), Fish tapeworm, Fitz-Hugh-Curtis syndrome—Perihepatitis, Flinders Island Spotted Fever, Flu (Influenza), Folliculitis, Four Corners Disease, Four Corners Disease (Human Pulmonary Syndrome (HPS)), Frambesia, Francis disease, Furunculosis, Gas gangrene, Gastroenteritis, Genital Herpes, Genital Warts, German measles, Gerstmann-Straussler-Scheinker (GSS), Giardiasis, Gilchrist's disease, Gingivitis, Gingivostomatitis, Glanders, Glandular fever (infectious mononucleosis), Gnathostomiasis, Gonococcal Infection (Gonorrhea), Gonorrhea, Granuloma inguinale (Donovanosis), Guinea Worm, Haemophilus Influenza disease, Hamburger disease, Hansen's disease—leprosy, Hantaan disease, Hantaan-Korean hemorrhagic fever, Hantavirus Pulmonary Syndrome, Hantavirus Pulmonary Syndrome (HPS), Hard chancre, Hard measles, Haverhill fever—Rat bite fever, Head and Body Lice, Heartland fever, Helicobacterosis, Hemolytic Uremic Syndrome (HUS), Hepatitis A, Hepatitis B, Hepatitis C, Hepatitis D, Hepatitis E, Herpangina, Herpes—genital, Herpes labialis, Herpes—neonatal, Hidradenitis, Histoplasmosis, Histoplasmosis infection (Histoplasmosis), His-Werner disease, HIV infection, Hookworm infections, Hordeola, Hordeola (Stye), HTLV, HTLV-associated myelopathy (HAM), Human granulocytic ehrlichiosis, Human monocytic ehrlichiosis, Human Papillomavirus (HPV), Human Pulmonary Syndrome, Hydatid cyst, Hydrophobia, Impetigo, Including congenital (German Measles), Inclusion conjunctivitis, Inclusion conjunctivitis+Swimming Pool conjunctivitis—Pannus, Infantile diarrhea, Infectious Mononucleosis, Infectious myocarditis, Infectious pericarditis, Influenza, Isosporiasis, Israeli spotted fever, Japanese Encephalitis, Jock itch, Jorge Lobo disease—lobomycosis, Jungle yellow fever, Junin Argentinian hemorrhagic fever, Kala Azar, Kaposi's sarcoma, Keloidal blastomycosis, Keratoconjunctivitis, Kuru, Kyasanur forest disease, LaCrosse encephalitis, Lassa hemorrhagic fevter, Legionellosis (Legionnaires Disease), Legionnaires pneumonia, Lemierre's Syndrome (Postanginal septicemia), Lemming fever, Leprosy, Leptospirosis (Nanukayami fever: Well's disease), Listeriosis (Listeria), Liver fluke infection, Lobo's mycosis, Lockjaw, Loiasis, Louping Ill, Ludwig's angina, Lung fluke infection, Lung fluke infection (Paragonimiasis), Lyme disease, Lymphogranuloma venereum infection (LGV), Machupo Bolivian hemorrhagic fever, Madura foot, Mal del pinto, Malaria, Malignant pustule, Malta fever, Marburg hemorrhagic fever, Masters disease, Maternal Sepsis (Puerperal fever), Measles, Mediterannean spotted fever, Melioidosis (Whitmore's disease), Meningitis, Meningococcal Disease, MERS, Milker's nodule, Molluscum contagiosum, Moniliasis, monkeypox, Mononucleosis, Mononucleosis-like syndrome, Montezuma's Revenge, Morbillih, MRSA (methicillin-resistant *Staphylococcus aureus*) infection, Mucormycosis-Zygonmycosis, Multiple Organ Dysfunction Syndrome or MODS, Multiple-system atrophy (MSA), Mumps, Murine typhus, Murray Valley Encephalitis (MVE), Mycoburuli ulcers, Mycoburuli ulcers-Buruli ulcers, Mycotic vulvovaginitis, Myositis, Nanukavami fever, Necrotizing fasciitis, Necrotizing fasciitis—Type 1, Necrotizing fasciitis—Type 2, Negishi, New world spotted fever, Nocardiosis, Nongonococcal urethritis, Non-Polio (Non-Polio Enterovirus), Norovirus infection, North American blastonmycosis, North Asian tick typhus, Norwalk virus infection, Norwegian itch, O'Hara disease, Omsk hemorrhagic fever, Onchocerciasis, Onychomycosis, Opisthorchiasis, Opthalmia neonatorium, Oral hairy leukoplakia, Orf, Oriental Sore, Oriental Spotted Fever, Omithosis (Parrot fever; Psittacosis), Oroya fever, Otitis externa, Otitis media, Pannus, Paracoccidioidomycosis, Paragonimiasis, Paralytic Shellfish Poisoning (Paralytic Shellfish Poisoning), Paronychia (Whitlow), Parotitis, PCP pneumonia, Pediculosis, Peliosis hepatica, Pelvic Inflammatory Disease, Pertussis (also called Whooping cough), Phaeohyphomycosis, Pharyngoconjunctival fever, Piedra (White Piedra), Piedra(Black Piedra), Pigbel, Pink eye conjunctivitis, Pinta, Pinworm infection, Pitted Keratolysis, Pityriasis versicolor (Tinea versicolor), Plague; Bubonic, Pleurodynia, Pneumococcal Disease, Pneumocystosis, Pneumonia, Pneumonic (Plague), Polio or Poliominvelitis, Polycystic hydatid, Pontiac fever, Pork tapeworm, Posada-Wemicke disease, Post-anginal septicemia, Powassan, Progressive multifocal leukencephalopathy, Progressive Rubella Panencephalitis, Prostatitis, Pseudomembranous colitis, Psittacosis, Puerperal fever, Pustular Rash diseases (Small pox), Pyelonephritis, Pylephlebitis, Q-Fever, Quinsy, Quintana fever (5-day fever), Rabbit fever, Rabies, Racoon roundworm infection, Rat bite fever, Rat tapeworm, Reiter Syndrome, Relapsing fever, Respiratory syncytial virus (RSV) infection, Rheumatic fever, Rhodotorulosis, Ricin Poisoning, Rickettsialpox, Rickettsiosis, Rift Valley Fever, Ringworm, Ritter's Disease, River Blindness, Rocky Mountain spotted fever, Rose Handler's disease (Sporotrichosis), Rose rash of infants, Roseola, Ross River fever, Rotavirus infection, Roundworm infections, Rubella, Rubeola, Russian spring, Salmonellosis gastroenteritis, San Joaquin Valley fever, Sao Paulo Encephalitis, Sao Paulo fever, SARS, Scabies Infestation (Scabies) (Norwegian itch), Scalded Skin Syndrome, Scarlet fever (Scarlatina), Schistosomiasis, Scombroid, Scrub typhus, Sennetsu fever, Sepsis (Septic shock), Severe Acute Respiratory Syndrome, Severe Acute Respiratory Syndrome (SARS), Shiga Toxigenic *Escherichia coli* (STEC/VTEC), Shigellosis gastroenteritis (Shigella), Shinbone fever, Shingles, Shipping fever, Siberian tick typhus, Sinusitis, Sixth disease, Slapped cheek disease, Sleeping sickness, Smallpox (Variola), Snail Fever, Soft chancre, Southern tick associated rash illness, Sparganosis, Spelunker's disease, Sporadic typhus, Sporotrichosis, Spotted fever, Spring, St, Louis encephalitis, Staphylococcal Food Poisoning, Staphylococcal Infection, Strep, throat, Streptococcal Disease, Streptococcal Toxic-Shock Syndrome, Strongyloiciasis, Stye, Subacute Sclerosing Panencephalitis, Subacute Sclerosing Panencephalitis (SSPE), Sudden Acute Respiratory Syndrome, Sudden Rash, Swimmer's ear, Swimmer's Itch, Swimming Pool conjunctivitis, Sylvatic yellow fever, Syphilis, Systemic Inflammatory Response Syndrome (SIRS), Tabes dorsalis (tertiary syphilis), Taeniasis, Taiga encephalitis, Tanner's disease, Tapeworm infections, Temporal lobe encephalitis, Temporal lobe encephalitis, tetani (Lock Jaw), Tetanus Infection, Threadwonn infections, Thrush, Tick, Tick typhus, Tinea barbae, Tinea capitis, Tinea corporis, Tinea cruris, Tinea manuum, Tinea nigra, Tinea pedis, Tinea unguiunm, Tinea versicolor, Torulopsosis, Torulosis, Toxic Shock Syndrome, Toxoplasmosis, transmissible spongioform (CJD), Traveler's diarrhea, Trench fever 5, Trichinellosis, Trichomoniasis, Trichomycosis axillaris, Trichuriasis, Tropical Spastic Paraparesis (TSP), Trypanosomiasis, Tuberculosis (TB), Tuberculousis, Tularemia, Typhoid Fever, Typhus fever, Ulcus molle, Undulant fever, Urban yellow fever, Urethritis, Vaginitis, Vaginosis, Vancomycin Intermediate (VISA), Vancomycin Resistant (VRSA), Varicella, Venezuelan Equune encephalitis, Verruga peruana, *Vibrio cholerae* (Cholera), Vibriosis (Vibrio), Vincent's disease or Trench mouth, Viral conjunctivitis, Viral Meningitis, Viral meningoencephalitis, Viral rash, Visceral Larval Migrans, Vornito negro, Vulvovaginitis, Warts, Waterhouse, Weil's disease, West Nile Fever, Western equine encephalitis, Whipple's disease, Whipworm infection, White Piedra, Whitlow, Whitmore's disease, Winter diarrhea, Wolhynia fever, Wool sorters' disease, Yaws, Yellow Fever, Yersinosis, Yersinosis (Yersinia), Zahorsky's disease, Zika virus disease, Zoster, Zygornmcosis, John Cunningham Virus (JCV), Human immunodeficiency virus (HIV), Influenza virus, Hepatitis B, Hepatitis C, Hepatitis D, Respiratory syncytial virus (RSV), Herpes simplex virus 1 and 2, Human Cytomegalovirus, Epstein-Barr virus, Varicella zoster virus, Coronaviruses, Poxviruses, Enterovirus 71, Rubella virus, Human papilloma virus, *Streptococcus pneumoniae, Streptococcus viridans, Staphylococcus aureus* (*S. aureus*), Methicillin-resistant *Staphylococcus aureus* (MRSA), Vancomycin-intermediate *Staphylococcus aureus* (VISA), Vancomycin-resistant *Staphylococus aureus* (VRSA), *Staphylococcus epidermidis* (*S. epidermidis*), *Clostridium teltani, Bordetella pertussis, Bordetelia paratussis, Mycobacterium, Francisella yularensis, Toxoplasma gondii, Candida* ((*C. albicans, C. glabrata, C. parapsilosis, C. tropicalis, C. krusei* and *C. lusiltaniae*) and/or any other infectious diseases, disorders or syndromes.

Various toxins may be treated with the pharmaceutical compositions, AAV particles, of the present invention. Non-limited examples of toxins include Ricin, *Bacillus anthracis*, Shiga toxin and Shiga-like toxin, Botulinum toxins.

Various tropical diseases may be treated with pharmaceutical compositions, AAV particles, of the present invention. Non-limited examples of tropical diseases include Chikungunya fever. Dengue fever. Chagas disease, Rabies, Malaria. Ebola virus, Marburg virus, West Nile Virus, Yellow Fever, Japanese encephalitis virus. St Louis encephalitis virus.

Various foodborne illnesses and gastroenteritis may be treated with pharmaceutical compositions, AAV particles, of the present invention. Non-limited examples of foodborne illnesses and gastroenteritis include Rotavirus, Norwalk virus (Norovirus), *Campylobacter jejuni, Clostridium difficile, Entamoeba histolytica, Helicobacter pylori*, Enterotoxin B of *Staphylococcus aureus*, H-lepatitis A virus (HAV), Hepatitis E. *Listeria* monocytogenes, *Salmonella, Clostridium perfringens*, and *Salmonella*.

Various infectious agents may be treated with pharmaceutical compositions, AAV particles, of the present invention. Non-limited examples of infectious agents include adenoviruses. *Anaplasma phagocytophilium, Ascaris lumbricoides, Bacillus anthracis, Bacillus cereus, Bacteroides* sp, Barmah Forest virus, *Bartonella bacilliformis, Bartonella henselae, Bartonella quintana*, beta-toxin of *Clostridium perifingens, Bordetella pertussis, Bordetella parapertussis, Borrelia burgdorferi, Borrelia miyamotoi, Borrelia recurrentis, Borreha* sp., *Botulinum* toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchts sinensis, Clostridium difficile* bacteria, *Clostridium tetani*, Colorado tick fever virus, *Corynebacterium diphtheriae, Corynebacterium minutissimum, Coxiella burneii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis, Ehrlichia equi, Ehrlichia* sp., *Entamoeba histolytica, Enterobacter* sp., *Enterococcus feacalis*, Enterovirus 71, Epstein-Barr virus (EBV), *Erysipelothrix rhusioplathiae, Escherichia coli,* Flavivirus, *Fusobacterium necrophorum, Gardnerella vaginalis*, Group B streptococcus, *Haemophilus aegyptius, Haemophilus ducreyi, Haemophilus influenzae*, hantavirus, *Helicobacter pylori*, Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses 1 and 11, influenza viruses (A, B, C), Jamestown Canyon virus, Japanese encephalitis antigenic, Japanese encephalitis virus, John Cunningham virus, juninvirus, Kaposi's Sarcoma-associated Herpes Virus (KSHV), *Klebsiella granulomatis, Klebsiella* sp., Kyasanur Forest Disease virus, La Crosse virus, Lassavirus, *Legionella pneumophila, Leptospira interrogans, Listeria monocytogenes,* lymphocytic choriomeningitis virus, lyssavirus, Machupovirus, Marburg virus, measles virus, MERS coronavirus (MERS-CoV), *Micrococcus sedentarius, Mobiliuncus* sp., Molluscipeoxvirus, *Moraxella catarrhalis, Morbilli-Ruheola* virus, Mumpsvirus, *Mycobacterium leprae, Mycobacterium tuberculosis, Mycobacterium ulcerans, Mycoplasma genitalium, Mycoplasma* sp. Nairovirus, *Neisseria gonorrhoeae, Neisseria menigitidis, Nocardia,* Norwalk virus, norovirus, Onmsk hemorrhagic fever virus, papilloma virus, parainfluenza viruses 1-3, parapoxvirus, parvovirus B19, *Peptostreptococccus* sp., *Plasmodium* sp., polioviruses types 1, 11, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii*, Ross River Virus, rotavirus, rubellavirus, Saint Louis encephalitis, *Salmonella typhi, Sarcoptes scabiei*, SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptococcus pneumoniae, Streptococcus agalactiae, Streptococcus agalacticae, Streptococcus* group A-H, *Streptococcus pneumoniae, Streptoccus pyogenes, Treponema pallidum* subsp. *Pallidum, Treponema pallidum* var. *carateum, Treponema pallidum* var. *endemicum, Tropheryma whippelii, Ureaplasma urealytcum*, Varicella-Zoster virus, variola virus, *Vibrio cholerae*, West Nile virus, yellow fever virus, *Yersinia enterocolitica, Yersinia pestis*, and Zika virus.

Various rare diseases may be treated with pharmaceutical compositions, AAV particles, of the present invention. As used herein, the term "rare disease" refers to any disease that affects a small percentage of the population. As a non-limiting example, the rare disease may be Acrocephalosyndactylia, Acrodermatitis, Addison Disease, Adie Syndrome, Alagille Syndrome, Amylose, Amyotrophic Lateral Sclerosis, Angelman Syndrome, Angiolymphoid Hyperplasia with Eosinophilia, Arnold-Chiari Malformation, Arthritis, Juvenile Rheumatoid, Asperger Syndrome, Bardet-Biedl Syndrome, Barrett Esophagus, Beckwith-Wiedemann Syndrome, Behcet Syndrome, Bloom Syndrome, Bowen's Disease, Brachial Plexus Neuropathies, Brown-Sequard Syndrome, Budd-Chiari Syndrome, Burkitt Lymphoma, Carcinoma 256, Walker, Caroli Disease, Charcot-Marie-Tooth Disease, Chediak-Hiigashi Syndrome, Chiari-Frommel Syndrome, Chondrodysplasia Punctata, Colonic Pseudo-Obstruction, Colorectal Neoplasms, Hereditary Nonpolyposis, Craniofacial Dysostosis, Creutzfeldt-Jakob Syndrome, Crohn Disease, Cushing Syndrome, Cystic Fibrosis, Dandy-Walker Syndrome, De Lange Syndrome, Dementia, Vascular, Dermatitis Herpetiformis, DiGeorge Syndrome, Diffuse Cerebral Sclerosis of Schilder, Duane Retraction Syndrome, Dupuytren Contracture, Ebstein Anomaly, Eisenmenger Complex, Ellis-Van Creveld Syndrome, Encephalitis, Enchondromatosis, Epidermal Necrolysis, Toxic, Facial Hemiatrophy, Factor XII Deficiency, Fanconi Anemia, Felty's Syndrome, Fibrous Dyvsplasia, Polvostotic, Fox-Fordyce Disease, Friedreich Ataxia, Fusobacterium, Gardner Syndrome, Gaucher Disease, Gerstmann Syndrome, Giant Lymph Node Hyperplasia, Glycogen Storage Disease Type I, Glycogen Storage Disease Type II, Glycogen Storage Disease Type IV, Glycogen Storage Disease Type V, Glycogen Storage Disease Type VII, Goldenhar Syndrome, Guillain-Barre Syndrome, Hallermann's Syndrome, Hamartoma Syndrome, Multiple, Hartnup Disease, Hepatolenticular Degeneration, Hepatolenticular Degeneration, Hereditary Sensory and Motor Neuropathy, Hirschsprung Disease, Histiocytic Necrotizing Lymphadenitis, Histiocytosis, Langerhans-Cell, Hodgkin Disease, Homer Syndrome, Huntington Disease, Hyperaldosteronism, Hyperhidrosis, Hyperostosis, Diffuse Idiopathic Skeletal, Hypopituitarism, Inappropriate ADH Syndrome, Intestinal Polyps, Isaacs Syndrome, Kartagener Syndrome, Keams-Sayre Syndrome, Klippel-Feil Syndrome, Klippel-Trenaunay-Weber Syndrome, Kluver-Bucy Syndrome, Korsakoff Syndrome, Lafora Disease, Lambert-Eaton Myasthenic Syndrome, Landau-Kleffner Syndrome, Langer-Giedion Syndrome, Leigh Disease, Lesch-Nyhan Syndrome, Leukodystrophy, Globoid Cell, Li-Fraumeni Syndrome, Long QT Syndrome, Machado-Joseph Disease, Mallory-Weiss Syndrome, Marek Disease, Marfan Syndrome, Meckel Diverticulum, Meige Syndrome, Melkersson-Rosenthal Syndrome, Meniere Disease, Mikulicz' Disease, Miller Fisher Syndrome, Mobius Syndrome, Moyamoya Disease, Mucocutaneous Lymph Node Syndrome, Mucopoly saccharidosis I, Mucopolysaccharidosis II, Mucopolysaccharidosis III, Mucopolysaccharidosis IV, Mucopolysaccharidosis VI, Multiple Endocrine Neoplasia Type 1, Munchausen Syndrome by Proxy, Muscular Atrophy, Spinal, Narcolepsy, Neuroaxonal Dystrophies, Neuromyelitis Optica, Neuronal Ceroid-Lipofuscinoses, Niemann-Pick Diseases, Noonan Syndrome, Optic Atrophies, Hereditary, Osteitis Deformans, Osteochondritis, Osteochondrodysplasias, Osteolysis, Essential, Paget Disease Extramammary, Paget's Disease, Mammary, Panuuculitis, Nodular Nonsuppurative, Papillon-Lefevre Disease, Paralysis, Pelizaeus-Merzbacher Disease, Pemphigus, Benign Familial, Penile Induration, Pericarditis, Constrictive, Peroxisomal Disorders, Peutz-Jeghers Syndrome, Pick Disease of the Brain, Pierre Robin Syndrome, Pigmentation Disorders, Pityriasis Lichenoides, Polycystic Ovary Syndrome, Polyendocrinopathies, Autoimmune, Prader-Willi Syndrome, Pupil Disorders, Rett Syndrome, Reye Syndrome, Rubinstein-Taybi Syndrome, Sandhoff Disease, Sarcoma, Ewing's, Schnitzler Syndrome, Sjogren's Syndrome, Sjogren-Larsson Syndrome, Smith-Lemli-Opitz Syndrome, Spinal Muscular Atrophies of Childhood, Sturge-Weber Syndrome, Sweating, Gustatory, Takayasu Arteritis, Tangier Disease, Tay-Sachs Disease, Thromboangiitis Obliterans, Thyroiditis, Autoimmune, Tietze's Syndrome, Togaviridae Infections, Tolosa-Hunt Syndrome, Tourette Syndrome, Uveomeningoencephalitic Syndrome, Waardenburg's Syndrome, Wegener Granulomatosis, Weil Disease, Werner Syndrome, Williams Syndrome, Wilms Tumor, Wolff-Parkinson-White Syndrome, Wolfram Syndrome, Wolman Disease, Zellweger Syndrome, Zollinger-Ellison Syndrome, and von Willebrand Diseases.

Various autoimmune diseases and autoimmune-related diseases may be treated with pharmaceutical compositions, AAV particles, of the present invention. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackle myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosus, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myositis, Narcolepsy, Neurormelitis optica (Devic's), Neutropenia, Ocular cicatricial pemphigoid, Optic neuritis, Palindromic rheumatism, PANDAS (Pediatric Autoimmune Neuropsychiatric Disorders Associated with Streptococcus), Paraneoplastic cerebellar degeneration, Paroxysmal nocturnal hemoglobnuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune polyglandular syndromes, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocy topenic purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, AAV particles, of the present invention. As a non-limiting example, the kidney disease Abderhalden-Kaufmann-Lignac syndrome (Nephropathic Cystinosis), Abdominal Compartment Syndrome, Acute Kidney Failure/Acute Kidney Injury, Acute Lobar Nephronia, Acute Phosphate Nephropathy, Acute Tubular Necrosis, Adenine Phosphoribosyltransferase Deficiency, Adenovirus Nephritis, Alport Syndrome, Amyloidosis, ANCA Vasculitis Related to Endocarditis and Other Infections, Angiomyolipoma, Analgesic Nephropathy, Anorexia Nervosa and Kidney Disease, Angiotensin Antibodies and Focal Segmental Glomerulosclerosis, Antiphospholipid Syndrome, Anti-TNF-α Therapy-related Glomerulonephritis, APOL1 Mutations, Apparent Mineralocorticoid Excess Syndrome, Aristolochic Acid Nephropathy, Chinese Herbal Nephropathy, Balkan Endemic Nephropathy, Bartter Syndrome, Beeturia, β-Thalassemia Renal Disease, Bile Cast Nephropathy, BK Polyoma Virus Nephropathy in the Native Kidney, Bladder Rupture, Bladder Sphincter Dyssynergia, Bladder Tamponade, Border-Crossers' Nephropathy, Bourbon Virus and Acute Kidney Injury, Burnt Sugarcane Harvesting and Acute Renal Dysfunction, Byetta and Renal Failure, C1q Nephropathy, Cannabinoid Hyperemesis Acute Renal Failure, Cardiorenal syndrome, Carfilzomib-Induced Renal Injury, CFHR5 nephropathy, Charcot-Marie-Tooth Disease with Glomerulopathy, Cherry Concentrate and Acute Kidney Injury, Cholesterol Emboli, Churg-Strauss syndrome, Chyluria, Colistin Nephrotoxicity, Collagenofibrotic Glomerulopathy, Collapsing Glomerulopathy, Collapsing Glomerulopathy Related to CMV, Congenital Nephrotic Syndrome, Conorenal syndrome (Mainzer-Saldino Syndrome or Saldino-Mainzer Disease), Contrast Nephropathy, Copper Sulpfate Intoxication, Cortical Necrosis, Crizotinib-related Acute Kidney Injury, Cryoglobinemia, Crystalglobulin-Induced Nephropathy, Crystal-Induced Acute Kidney injury, Cystic Kidney Disease, Acquired, Cystinuria, Dasatinib-Induced Nephrotic-Range Proteinuria, Dense Deposit Disease (MPGN Type 2), Dent Disease (X-linked Recessive Nephrolithiasis), Dialysis Disequilibrium Syndrome, Diabetes and Diabetic Kidney Disease, Diabetes Insipidus, Dietary Supplements and Renal Failure, Drugs of Abuse and Kidney Disease, Duplicated Ureter, EAST syndrome, Ebola and the Kidney, Ectopic Kidney, Ectopic Ureter, Edema, Swelling, Erdheim-Chester Disease, Fabry's Disease, Familial Hypocalciuric Hypercalcemia, Fanconi Syndrome, Fraser syndrome, Fibronectin Glomerulopathy, Fibrillary Glomerulonephritis and Immunotactoid Glomerulopathy, Fraley syndrome, Focal Segmental Glomerulosclerosis, Focal Sclerosis, Focal Glomerulosclerosis, Galloway Mowat syndrome, Giant Cell (Temporal) Arteritis with Kidney Involvement, Gestational Hypertension, Gitelman Syndrome, Glomerular Diseases, Glomerular Tubular Reflux, Glycosuria, Goodpasture Syndrome, Hair Dye Ingestion and Acute Kidney Injury, Hantavirus Infection Podocytopathy, Hematuria (Blood in Urine), Hemolytic Urermic Syndrome (HUS), Atypical Hemolytic Uremic Syndrome (aHUS), Hemophagocytic Syndrome, Hemorrhagic Cystitis, Hemorrhagic Fever with Renal Syndrome (HFRS, Hantavirus Renal Disease, Korean Hemorrhagic Fever, Epidemic Hemorrhagic Fever, Nephropathis Epidemica), Hemosiderosis related to Paroxysmal Nocturnal Hemoglobinuria and Hemolytic Anemia, Hepatic Glomerulopathy, Hepatic Veno-Occlusive Disease, Sinusoidal Obstruction Syndrome, Hepatitis C-Associated Renal Disease, Hepatorenal Syndrome, Herbal Supplements and Kidney Disease, High Blood Pressure and Kidney Disease, HIV-Associated Nephropathy (HIVAN), Horseshoe Kidney (Renal Fusion), Hunner's Ulcer, Hyperaldosteronism, Hypercalcemia, Hyperkalemia, Hypermagnesemia, Hypermanesemia, Hypernatremia, Hyperoxaluria, Hyperphosphatemia, Hypocalcemia, Hypokalemia, Hypokalemia-induced renal dysfunction, Hypokalemic Periodic Paralysis, Hypomagnesemia, Hyponatremia, Hypophosphatemia, IgA Nephropathy, IgG4 Nephropathy, Interstitial Cystitis, Painful Bladder Syndrome (Questionnaire), Interstitial Nephritis, Ivemark's syndrome, Ketamine-Associated Bladder Dysfunction, Kidney Stones, Nephrolithiasis, Kombucha Tea Toxicity, Lead Nephropathy and Lead-Related Nephrotoxicity, Leptospirosis Renal Disease, Light Chain Deposition Disease, Monoclonal Immunoglobulin Deposition Disease, Liddle Syndrome, Lightwood-Albright Syndrome, Lipoprotein Glomerulopathy, Lithium Nephrotoxicity, LMXIB Mutations Cause Hereditary FSGS, Loin Pain Hematuria, Lupus, Systemic Lupus Erythematosis, Lupus Kidney Disease, Lupus Nephritis, Lupus Nephritis with Antineutrophil Cytoplasmic Antibody Seropositivity, Lyme Disease-Associated Glomerulonephritis, Malarial Nephropathy, Malignancy-Associated Renal Disease, Malignant Hypertension, Malakoplakia, Meatal Stenosis, Medullary Cystic Kidney Disease, Medullary Sponge Kidney, Megaureter, Melamine Toxicity and the Kidney, Membranoproliferative Glomerulonephritis, Membranous Nephropathy, MesoAmerican Nephropathy, Metabolic Acidosis, Metabolic Alkalosis, Methotrexate-related Renal Failure, Microscopic Polyangiitis, Milk-alkalai syndrome, Minimal Change Disease, MDMA (Molly, Ecstacy; 3,4-Methylenedioxymnethamphetamine) and Kidney Failure, Multicystic dysplastic kidney, Multiple Myeloma, Myeloproliferative Neoplasms and Glomerulopathy, Nail-patella Syndrome, Nephrocalcinosis, Nephrogenic Systemic Fibrosis, Nephroptosis (Floating Kidney, Renal Ptosis), Nephrotic Syndrome, Neurogenic Bladder, Nodular Glomerulosclerosis, NonGonococcal Urethritis, Nutcracker syndrome, Orofaciodigital Syndrome, Orotic Aciduria, Orthostatic Hypotension, Orthostatic Proteinurina, Osmotic Diuresis, Ovarian Hyperstimulation Syndrome, Page Kidney, Papillary Necrosis, Papillorenal Syndrome (Renal-Coloboma Syndrome, Isolated Renal Hypoplasia), Parvovirus B19 and the Kidney, The Peritoneal-Renal Syndrome, Posterior Urethral Valve, Post-infectious Glomerulonephritis, Post-streptococcal Glomerulonephritis, Polyarteritis Nodosa, Polycystic Kidney Disease, Posterior Urethral Valves, Preeclampsia, Propofol infusion syndrome, Proliferative Glomerulonephritis with Monoclonal IgG Deposits (Nasr Disease), Propolis (Honeybee Resin) Related Renal Failure, Proteinuria (Protein in Urine), Pseudohyperaldosteronism, Pseudohypobicarbonatemia, Pseudohypoparathyroidism, Pulmonary-Renal Syndrome, Pyelonephritis (Kidney Infection), Pyonephrosis, Radiation Nephropathy, Ranolazine and the Kidney, Refeeding syndrome, Reflux Nephropathy, Rapidly Progressive Glomerulonephritis, Renal Abscess, Peripnephric Abscess, Renal Agenesis, Renal Arcuate Vein Microthrombi-Associated Acute Kidney Injury, Renal Artery Aneurysm, Renal Artery Stenosis, Renal Cell Cancer, Renal Cyst, Renal Hypouricemia with Exercise-induced Acute Renal Failure, Renal Infarction, Renal Osteodystrophy, Renal Tubular Acidosis, Renin Secreting Tumors (Juxtaglomerular Cell Tumor), Reset Osmostat, Retrocaval Ureter, Retroperitoneal Fibrosis, Rhabdomyolysis, Rhabdomyolysis related to Bariatric Sugery, Rheumatoid Arthritis-Associated Renal Disease, Sarcoidosis Renal Disease, Salt Wasting, Renal and Cerebral, Schistosomiasis and Glomerular Disease, Schimke immuno-osseous dysplasia, Scleroderma Renal Crisis, Serpentine Fibula-Polycystic Kidney Syndrome, Exner Syndrome, Sickle Cell Nephropathy, Silica Exposure and Chronic Kidney Disease, Sri Lankan Farmers' Kidney Disease, Sjögren's Syndrome and Renal Disease, Synthetic Cannabinoid Use and Acute Kidney Injury, Kidney Disease Following Hematopoietic Cell Transplantation, Kidney Disease Related to Stem Cell Transplantation, Thin Basement Membrane Disease, Benign Familial Hematuria, Trigonitis, Tuberculosis, Genitourinary, Tuberous Sclerosis, Tubular Dysgenesis, Immune Complex Tubulointerstitial Nephritis Due to Autoantibodies to the Proximal Tubule Brush Border, Tumor Lysis Syndrome, Uremia, Uremic Optic Neuropathy, Ureteritis Cystica, Ureterocele, Urethral Caruncle, Urethral Stricture, Urinary Incontinence, Urinary Tract Infection, Urinary Tract Obstruction, Vesicointestinal Fistula, Vesicoureteral Reflux, Volatile Anesthetics and Acute Kidney Injury, Von Hippel-Lindau Disease, Waldenstrom's Macroglobulinemic Glomerulonephritis, Warfarin-Related Nephropathy, Wasp Stings and Acute Kidney Injury, Wegener's Granulomatosis, Granulomatosis with Polyangiitis, West Nile Virus and Chronic Kidney Disease, and Wunderlich syndrome.

Various cardiovascular diseases may be treated with pharmaceutical compositions, AAV particles, of the present invention. As a non-limiting example, the cardiovascular disease may be Ischemic heart disease also known as coronary artery disease, cerebrovascular disease (Stroke), Peripheral vascular disease, Heart failure, Rheumatic heart disease, and Congenital heart disease.

Various antibody deficiencies may be treated with pharmaceutical compositions, AAV particles, of the present invention. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1, IgG2, IgG3 and IgG4) Subclass Deficiency, Selective IgA Deficiency, Specific Antibody Deficiency (SAD). Transient Hypogammaglobulinemia of Infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia, Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, AAV particles, of the present invention. As a non-limiting example, the ocular disease may be thyroid eye disease (TED), Graves' disease (GD) and orbitopathy, Retina Degeneration. Cataract, optic atrophy, macular degeneration, Leber congenital amaurosis, retinal degeneration, cone-rod dystrophy, Usher syndrome, leopard syndrome, photophobia, and photoaversion.

Various neurological diseases may be treated with pharmaceutical compositions, AAV particles, of the present invention. As a non-limiting example, the neurological disease may be Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adle's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Amold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Sub-cortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavernous Malformation, Cerebral Gigantism, Cerebral Hypoxia, Cerebral Palsy, Cerebro-Oculo-Facio-Skeletal Syndrome (COFS), Charcot-Mane-Tooth Disease, Chian Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, De Morsier's Syndrome, Dejerine-Klumpke Palsy, Dementia, Dementia—Multi-Infarct, Dementia—Semantic, Dementia—Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Anglomatosis, Epilepsy, Epileptic Hermplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Savre Syndrome, Kennedy's Disease, Kinsbourne syndrome, Kleine-Levin Syndrome, Klippel-Feil Syndrome, Klippel-Trenaunay Syndrome (KTS), Klüver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy—Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy—Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjögren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syrmgomyella, Systemic Lupus Erythematosus, Tabes Dorsalis, Tardive Dyskinesia, Tarlov, Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome. Wilson Disease. Wolman's Disease. X-Linked Spinal and Bulbar Muscular Atrophy.

Various psychological disorders may be treated with pharmaceutical compositions, AAV particles, of the present invention. As a non-limiting example, the psychological disorders may be Aboulia, Absence epilepsy, Acute stress Disorder, Adjustment Disorders, Adverse effects of medication NOS, Age related cognitive decline, Agoraphobia, Alcohol Addiction, Alzheimer's Disease, Amnesia (also known as Amnestic Disorder), Amphetamine Addiction, Anorexia Nervosa, Anterograde amnesia, Antisocial personality disorder (also known as Sociopathy), Anxiety Disorder (Also known as Generalized Anxiety Disorder), Anxiolytic related disorders, Asperger's Syndrome (now part of Autism Spectrum Disorder), Attention Deficit Disorder (Also known as ADD), Attention Deficit Hyperactivity Disorder (Also known as ADHD), Autism Spectrum Disorder (also known as Autism), Autophagia, Avoidant Personality Disorder, Barbiturate related disorders, Benzodiazepine related disorders, Bereavement, Bibliomania, Binge Eating Disorder, Bipolar disorder (also known as Manic Depression, includes Bipolar I and Bipolar II), Body Dysmorphic Disorder, Borderline intellectual functioning, Borderline Personality Disorder, Breathing-Related Sleep Disorder, Brief Psychotic Disorder, Bruxism, Bulimia Nervosa, Caffeine Addiction, Cannabis Addiction, Catatonic disorder, Catatonic schizophrenia, Childhood amnesia, Childhood Disintegrative Disorder (now part of Autism Spectrum Disorder), Childhood Onset Fluency Disorder (formerly known as Stuttering), Circadian Rhythm Disorders, Claustrophobia, Cocaine related disorders, Communication disorder, Conduct Disorder, Conversion Disorder, Cotard delusion, Cyclothymia (also known as Cyclothymic Disorder), Delerium, Delusional Disorder, dementia, Dependent Personality Disorder (also known as Asthenic Personality Disorder), Depersonalization disorder (now known as Depersonalization/Derealization Disorder), Depression (also known as Major Depressive Disorder), Depressive personality disorder, Derealization disorder (now known as Depersonalization/Derealization Disorder), Dermotillomania, Desynchronosis, Developmental coordination disorder, Diogenes Syndrome, Disorder of written expression, Dispareunia, Dissocial Personality Disorder, Dissociative Amnesia, Dissociative Fugue, Dissociative Identity Disorder (formerly known as Multiple Personality Disorder), Down syndrome, Dyslexia, Dyspareunia, Dysthymia (now known as Persistent Depressive Disorder), Eating disorder NOS, Ekbom's Syndrome (Delusional Parasitosis), Emotionally unstable personality disorder, Encopresis, Enuresis (bedwetting), Erotomania, Exhibitionistic Disorder, Expressive language disorder, Factitious Disorder, Female Sexual Disorders, Fetishistic Disorder, Folie à deux, Fregoli delusion, Frotteuristic Disorder, Fugue State, Ganser syndrome, Gambling Addiction, Gender Dysphoria (formerly known as Gender Identity Disorder), Generalized Anxiety Disorder, General adaptation syndrome, Grandiose delusions, Hallucinogen Addiction, Haltlose personality disorder, Histrionic Personality Disorder, Primary hypersomnia, IHuntington's Disease, Hypoactive sexual desire disorder, Hypochondriasis, Hypomania, Hyperkinetic syndrome, Hypersomnia, Hysteria, Impulse control disorder, Impulse control disorder NOS, Inhalant Addiction, Insomnia, Intellectual Development Disorder, Intermittent Explosive Disorder, Joubert syndrome, Kleptomania, Korsakoff's syndrome, Lacunar amnesia, Language Disorder, Learning Disorders, Major Depression (also known as Major Depressive Disorder), major depressive disorder, Male Sexual Disorders, Malingering, Mathematics disorder, Medication-related disorder, Melancholia, Mental Retardation (now known as Intellectual Development Disorder), Misophonia, Morbid jealousy, Multiple Personality Disorder (now known as Dissociative Identity Disorder), Munchausen Syndrome, Munchausen by Proxy, Narcissistic Personality Disorder, Narcolepsy, Neglect of child, Neurocognitive Disorder (formerly known as Dementia), Neuroleptic-related disorder, Nightmare Disorder, Non Rapid Eye Movement, Obsessive-Compulsive Disorder, Obsessive-Compulsive Personality Disorder (also known as Anankastic Personality Disorder), Oneirophrenia, Onychophagia, Opioid Addiction, Oppositional Defiant Disorder, Orthorexia (ON), Pain disorder, Panic attacks, Panic Disorder, Paranoid Personality Disorder, Parkinson's Disease, Partner relational problem, Passive-aggressive personality disorder, Pathological gambling, Pedophilic Disorder, Perfectionism, Persecutory delusion, Persistent Depressive Disorder (also known as Dysthymia), Personality change due to a general medical condition, Personality disorder, Pervasive developmental disorder (PDD), Phencyclidine related disorder, Phobic disorder, Phonological disorder, Physical abuse, Pica, Polysubstance related disorder, Postpartum Depression, Post-traumatic embitterment disorder (PTED), Post Traumatic Stress Disorder, Premature ejaculation, Premenstrual Dysphoric Disorder, Psychogenic amnesia, Psychological factor affecting medical condition, Psychoneurotic personality disorder, Psychotic disorder, not otherwise specified, Pyromania, Reactive Attachment Disorder, Reading disorder, Recurrent brief depression, Relational disorder, REM Sleep Behavior Disorder, Restless Leg Syndrome, Retrograde amnesia, Retts Disorder (now part of Autism Spectrum Disorder), Rumination syndrome, Sadistic personality disorder, Schizoaffective Disorder, Schizoid Personality Disorder, Schizophrenia, Schizophreniform disorder, Schizotypal Personality Disorder, Seasonal Affective Disorder, Sedative, Hypnotic, or Anxiolytic Addiction, Selective Mutism, Self-defeating personality disorder, Separation Anxiety Disorder, Sexual Disorders Female, Sexual Disorders Male, Sexual Addiction, Sexual Masochism Disorder, Sexual Sadism Disorder, Shared Psychotic Disorder, Sleep Arousal Disorders, Sleep Paralysis, Sleep Terror Disorder (now part of Nightmare Disorder, Social Anxiety Disorder, Somatization Disorder, Specific Phobias, Stendhal syndrome, Stereotypic movement disorder, Stimulant Addiction, Stuttering (now known as Childhood Onset Fluency Disorder), Substance related disorder, Tardive dyskinesia, Tobacco Addiction, Tourettes Syndrome, Transient tic disorder, Transient global amnesia, Transvestic Disorder, Trichotillomania, Undifferentiated Somatoform Disorder, Vaginismus, and Voyeunstic Disorder.

Various lung diseases may be treated with pharmaceutical compositions, AAV particles, of the present invention. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoimmune Hepatitis, Biliary Atresia, Cirrhosis, ERCP (Endoscopic Retrograde Cholangiopancreatography), and Hemochromatosis, Nonalcoholic Steatohepatitis, Porphyria, Primary Biliary Cirrhosis, Primary Sclerosing Cholangitis.

Various bone diseases may be treated with pharmaceutical compositions, AAV particles, of the present invention. As a non-limiting example, the bone diseases may be osteoporosis, neurofibromatosis, osteogenesis imperfecta (OI), rickets, osteosarcoma, achondroplasia, fracture, osteomyelitis, Ewing tumour of bone, osteomalacia, hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, AAV particles, of the present invention. As a non-limiting example, the blood diseases may be Anemia and CKD (for health care professionals), Aplastic Anemia and Myelodysplastic Syndromes, Deep Vein Thrombosis, Hemochromatosis, Hemophilia, Henoch-Schönlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobminopathies, Thalassemia, Thrombotic Thrombocytopenic Purpura, and Von Willebrand Disease.

Various diseases associated with TNF-alpha may be treated with the pharmaceutical compositions, AAV particles, of the present invention. As a non-limiting example, the disease may be respiratory disorder; asthma; allergic and nonallergic asthma; asthma due to infection; asthma due to infection with respiratory syncytial virus (RSV); chronic obstructive pulmonary disease (COPD); a condition involving airway inflammation; eosinophilia; fibrosis and excess mucus production; cystic fibrosis; pulmonary fibrosis; an atopic disorder; atopic dermatitis; urticaria, eczema; allergic rhinitis; allergic enterogastritis; an inflammatory and/or autoimmune condition of the skin; an inflammatory and/or autoimmune condition of gastrointestinal organs, inflammatory bowel diseases (IBD); ulcerative colitis; Crohn's disease; an inflammatory and/or autoimmune condition of the liver; liver cirrhosis; liver fibrosis; liver fibrosis caused by hepatitis B and/or C virus, scleroderma; tumors or cancers; hepatocellular carcinoma, glioblastoma; lymphoma; Hodgkin's lymphoma; a viral infection; a bacterial infection; a parasitic infection; HTLV-1 infection; suppression of expression of protective type 1 immune responses, and suppression of expression of a protective type 1 immune response during vaccination, rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia greata, seronegative arthropathy, arthropathy, Reiter's disease, psoriatic arthropathy, ulcerative colitic arthropathy, enteropathic synovitis, chlamydia, yersinia and salmonella associated arthropathy, spondyloarthropathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cyptogenic autoimmune hepatitis, Acquired Immunodeficiency Disease Syndrome, Acquired Immunodeficiency Related Diseases, hepatitis B, hepatitis C, common varied immunodeficiency (common variable hypogammaglobulinemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasculitis of the kidneys, Lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoederma, phacogenic uveitis, primary vasculitis, vitiligo acute liver disease, chronic liver diseases, alcoholic cirrhosis, alcohol-induced liver injury, choleostasis, idiosyncratic liver disease, drug-Induced hepatitis, non-alcoholic steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma) abetalipoproteinemia, acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti-CD3 therapy, antiphospholipid syndrome, anti-receptor hypersensitivity reactions, aortic and peripheral aneurysms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, corpulmonale, coronary artery disease, Creutzfeldt-Jakob disease, culture negative sepsis, cystic fibrosis, cytokine therapy associated disorders, dementia pugilistica, demyelinating diseases, dengue hemorrhagic fever, dermatitis, dermatologic conditions, diabetes, diabetes mellitus, diabetic arteriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, Epstein-Barr virus infection, erythromelalgia, extrapyramidal and cerebellar disorders, familial hemophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallervorden-Spatz disease, Hashimoto's thyroiditis, hay fever, heart transplant rejection, hemochromatosis, hemodialysis, hemolytic uremic syndrome/thrombolytic thrombocytopenic purpura, hemorrhage, hepatitis (A), His bundle arrhythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis (JRA), juvenile spinal muscular atrophy, Kaposi's sarcoma, kidney transplant rejection, legionella, leishmaniasis, leprosy, lesions of the corticospinal system, lipedema, liver transplant rejection, lymphedema, malaria, malignant lymphoma, malignant histiocytosis, malignant melanoma, meningitis, meningococcemia, metabolic/idiopathic, migraine headache, mitochondrial multi-system disorder, mixed connective tissue disease, monoclonal gammopathy, multiple myeloma, multiple systems degenerations (Menzel, Dejerine-Thomas, Shy-Drager, and Machado-Joseph), myasthenia gravis, *Mycobacterium avium* intracellulare, nmycobacterium tuberculosis, myelodysplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-Hodgkins lymphoma, occlusion of the abdominal aorta and its branches, occlusive arterial disorders, OKT3® therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherosclerotic disease, peripheral vascular disorders, peritonitis, pernicious anemia, Pneumocystis carinii pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, progressive supranucleo palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, senile dementia of Lewy body type, seronegative arthropathies, shock, sickle cell anemia, skin allograft rejection, skin changes syndrome, small bowel transplant rejection, solid tumors, specific arrhythmias, spinal ataxia, spinocerebellar degenerations, streptococcal myositis, structural lesions of the cerebellum, subacute sclerosing panencephalitis, syncope, syphilis of the cardiovascular system, systemic anaphylaxis, systemic inflammatory response syndrome, systemic onset juvenile rheumatoid arthritis, T-cell or FAB ALL, telangiectasia, thromboangitis obliterans, thrombocytopenia, toxicity, transplants, trauma/hemorrhage, type III hypersensitivity reactions, type IV hypersensitivity, unstable angina, uremia urosepsis, urticaria, valvular heart diseases, varicose veins, vasculitis, venous diseases, venous thrombosis, ventricular fibrillation, viral and fungal infections, viral encephalitis/aseptic meningitis, viral-associated hemophagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia greata, anaphylaxis, anti-phospholipid antibody syndrome, aplastic anemia, arteriosclerosis, atopic eczema, atopic dermatitis, autoimmune dermatitis, autoimmune disorder associated with streptococcus infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (CIS) with risk for multiple sclerosis, conjunctivitis, childhood onset psychiatric disorder, chronic obstructive pulmonary disease (COPD), dacryocytitis, dermatomyositis, diabetic retinopathy, diabetes mellitus, disk herniation, disk prolapse, drug induced immune hemolytic anemia, endocarditis, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojunctivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery disease (PAD), phlebitis, polyarteritis nodosa (or periarteritis nodosa), polychondritis, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, Sneddon-Wilkinson dermatosis, spondylitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor associated periodic syndrome), type 1 allergic reaction, type II diabetes, urticaria, usual interstitial pneumonia (UIP), vasculitis, vernal conjunctivitis, viral retinitis, Vogt-Koyanagi-Harada syndrome (VKH syndrome), wet macular degeneration, wound healing, yersinia or salmonella associated arthropathy.

Various receptor for advanced gly cation endproducts (RAGE) diseases may be treated with the pharmaceutical compositions, AAV particles, of the present invention. As a non-limiting example, the disease may be Amytropic Lateral Sclerosis, Brachial Plexus Injury, Brain Injury, including traumatic brain injury, Cerebral Palsy, Friedrich's Ataxia, Guillain Barre, Leukodystrophies, Multiple Sclerosis, Post Polio, Spina Bifida, Spinal Cord Injury, Spinal Muscle Atrophy, Spinal Tumors, Stroke, Transverse Myelitits, dementia, senile dementia, mild cognitive impairment, Alzheimer-related dementia, Huntington's chorea, tardive dyskinesia, hyperkinesias, manias, Morbus Parkinson, steel-Richard syndrome, Down's syndrome, myasthenia gravis, nerve trauma, vascular amyloidosis, cerebral hemorrhage I with amyloidosis, brain inflammation, Friedrich's ataxia, acute confusion disorder, amyotrophic lateral sclerosis, glaucoma, Alzheimer's disease, diabetic nephropathy, sepsis, rheumatoid arthritis and related inflammatory diseases.

Various neurite degenerative diseases may be treated with the pharmaceutical compositions, AAV particles, of the present invention. As a non-limiting example, the disease may be multiple sclerosis, Parkinson's disease, Alzheimer's disease, Tay-Sachs disease, Niemann-Pick disease, Gaucher's disease, Hurler's syndrome, Huntington's disease, amyotrophic lateral sclerosis, idiopathic inflammatory demyelinating diseases, vitamin B12 deficiency, central pontine myelinolysis, tabes dorsalis, transverse myelitis, Devic's disease, progressive multifocal leukoencephalopathy, optic neuritis, traumatic injury to the CNS, an ischemic cerebral stroke, glaucoma, diabetic retinopathy, age-dependent macular degeneration, and a leukodystrophy.

Various neurological diseases may be treated with the pharmaceutical compositions, AAV particles, of the present invention. As a non-limiting example, the disease may be Amyotrophic Lateral Sclerosis, Brachial Plexus Injury, Brain Injury, including traumatic brain injury, Cerebral Palsy, Guillain Barre, Leukodystrophies, Multiple Sclerosis, Post Polio, Spina Bifida, Spinal Cord Injury, Spinal Muscle Atrophy, Spinal Tumors, Stroke, Transverse Myelitis;

dementia, senile dementia, mild cognitive impairment, Alzheimer-related dementia, Huntington's chorea, tardive dyskinesia, hyperkinesias, manias, Morbus Parkinson, steel-Richard syndrome, Down's syndrome, myasthenia gravis, nerve trauma, vascular amyloidosis, cerebral hemorrhage I with amyloidosis, brain inflammation, acute confusion disorder, amyotrophic lateral sclerosis, glaucoma and Alzheimer's disease.

Various cancers may be treated with pharmaceutical compositions, AAV particles, of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the AAV particles of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma lymphoma/leukemia, squamous cell carcinoma, small cell carcinoma, large cell undifferentiated carcinomas, basal cell carcinoma and sinonasal undifferentiated carcinoma.

Types of sarcomas which may be treated with the AAV particles of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, tibrosarcoma, hemangiopericytoma, hemangiosarcoma, Kaposi's sarcoma, leiomyosarcoma, liposarcoma, lymphangiosarcoma lymphosarcoma, malignant fibrous histiocytoma, neurofibrosarcoma, rhabdonyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the cancer which may be treated may be Acute granulocytic leukemia Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epitheloid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchy mal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple melanoma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

The AAV particles or pharmaceutical compositions of the present invention useful in preventing or treating HIV and AIDS may alternatively, or in combination, encode an antibody that targets a different infectious agent (e.g., an infectious agent that is not HIV-1 or 2). Non-limiting examples of other target antigens include any of the following, including fragments or variants thereof, adenoviruses, *Anaplasma phagocytophilium, Ascaris lumbricoides, Bacillus anthracis, Bacillus cereus, Bacteroides* sp, Barmah Forest virus, *Bartonella bacilliformis, Bartonella henselae, Bartonella quintona*, beta-toxin of *Clostridium perfringens, Bordetella pertussis, Bordetella parapertussis, Borrelia burgdorferi, Borrelia miyamotoi, Borrelia recurrentis, Borrelia* sp., *Botulinum* toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchis sinensis, Clostridium difficile* bacteria, *Clostridium tetani*, Colorado tick fever virus, *Corynebacterium diphtheriae, Corynebacterium minutissimum, Coxiella burnetii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis, Ehrlichia equi, Ehrlichia* sp. *Entamoeba histolytica, Enterobacter* sp., *Enterococcus feacalis*, Enterovirus 71, Epstein-Barr virus (EBV), *Erysipelothrix rhusiopathiae, Escherichia coli*, Flavivirus, *Fusobacterium necrophorum, Gardnerella vaginalis*, Group B *streptococcus, Haemophilus aegyptius, Haemophilus ducreyi, Haemophilus influenzae*, hantavirus, *Helicobacter pylori*, Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses I and II, influenza viruses (A, B, C), Jamestown Canyon virus, Japanese encephalitis antigenic, Japanese encephalitis virus, John Cunninham virus, juninvirus, Kaposi's Sarcoma-associated Herpes Virus (KSHV), *Klebsiella granulomatis, Klebsiella* sp., Kyasanur Forest Disease virus, La Crosse virus, Lassavirus, *Legionella pneumophila, Leptospira interrogans, Listeria monocytogenes*, lymphocytic choriomeningitis virus, lyssavirus, Machupovirus, Marburg virus, measles virus, MERS coronavirus (MERS-CoV), *Mictococcus sedentarius, Mobiluncus* sp., *Molluscipoxvirus, Moraxella catarrhalis, Morbilli-Rubeola* virus, Mumpsvirus, *Mycobacterium leprae, Mycobacterium tuberculosis, Mycobacterium ulcerans, Mycoplasma genitalium, Mycoplasma* sp, Nairovirus, *Neisseria gonorrhoeae, Neisseria meningitidis, Nocardia*, Norwalk virus, norovirus, Omsk hemorrhagic fever virus, papilloma virus, parainfluenza viruses 1-3, parapoxvirus, parvovirus B19, *Peptostreptococcus* sp., *Plasmodium* sp., polioviruses types I, II, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii*, Ross River Virus, rotavinrus, rubellavirus, Saint Louis encephalitis, *Salmonella typhi, Sarcoptes scabiei*, SARS-associated coronavirus (SARS-CoV), *Serrana* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptococcus pneumoniae, Streptococcus agalactiae, Streptococcus agalactiae, Streptococcus* group A-H, *Streptococcus pneumoniae, Streptococcus pyogenes, Treponema pallidum* subsp. *Pallidum, Treponema palladium* var. *carateum, Treponema pallidum* var. *endemicum, Tropheryma whippelii, Ureaplasma urealyticum*, Varicella-Zoster virus, variola virus, *Vibrio cholerae*, West Nile virus, yellow fever virus, *Yersinia enterocolitica, Yersinia pestis*, Zika virus.

Diagnostic Applications

The AAV particles of the present invention may be used for diagnostic purposes or as diagnostic tools for any of the aforementioned diseases or disorders. As a non-limiting example, the AAV particles of the present invention or the antibodies encoded within the viral genome therein may be used as a biomarker for disease diagnosis. As a second non-limiting example, the AAV particles of the present invention or the antibodies encoded within the viral genome therein may be used for diagnostic imaging purposes, e.g., MRI. PET, CT or ultrasound.

Preventative Applications

The AAV particles of the present invention or the antibodies encoded by the viral genome therein may be used to prevent disease or stabilize the progression of disease. In one embodiment, the AAV particles of the present invention are used to as a prophylactic to prevent a disease or disorder in the future. In one embodiment, the AAV particles of the present invention are used to halt further progression of a disease or disorder. As a non-limiting example, the AAV particles of the invention may be used in a manner similar to that of a vaccine.

Research Applications

The AAV particles of the present invention or the antibodies encoded by the viral genome therein may also be used as research tools. The AAV particles of the invention used as in any research experiment, e.g., in vivo or in vitro experiments. In a non-limiting example, the AAV particles of the invention may be used in cultured cells. The cultured cells may be derived from any origin known to one with skill in the art, and may be as non-limiting examples, derived from a stable cell line, an animal model or a human patient or control subject. In a non-limiting example, the AAV particles of the invention may be used in in vivo experiments in animal models (i.e., mouse, rat, rabbit, dog, cat, non-human primate, guinea pig, ferret, c-elegans, drosophila, zebrafish, or any other animal used for research purposes, known in the art). In another non-limiting example, the AAV particles of the invention may be used in human research experiments or human clinical trials.

Combination Applications

The AAV particles of the invention may be used as a combination therapy with any other therapeutic molecule known in the art. The therapeutic molecule may be approved by the US Food and Drug Administration or may be in clinical trial or at the preclinical research stage. The therapeutic molecule may utilize any therapeutic modality known in the art, with non-limiting examples including gene silencing or interference (i.e., miRNA, siRNA, RNAi, shRNA), gene editing (i.e., TALEN, CRISPRCas9 systems, zinc finger nucleases), and gene, protein or enzyme replacement.

Therapeutic Applications: Infectious Diseases

AAV particles and methods of using the AAV particles described in the present invention may be used to prevent, manage and/or treat infectious disease. As a non-limiting example, the AAV particles of the present invention comprise a nucleic acid sequence encoding at least one of the sequences described in Tables 21-42 (SEQ ID NO: 4138-9220).

The methods, components and compositions of the present invention may be used to diagnose, prevent, treat and/or manage infectious diseases. Infectious diseases, also known as transmissible diseases or communicable diseases, are caused by invasion and multiplication of agents in the body. Infection agents are species typically not present within the body and may be, but are not limited to, viruses, bacteria, prions, nematodes, fungus, parasites or arthropods. Additionally, an infection or symptoms associated with an infection may be caused by one or more toxins produced by such agents. Humans, and other mammals, react to infections with an innate immune system response, often involving an inflammation. The illnesses and symptoms involved with infections vary according to the infectious agent. Many infections may be subclinical without presenting any definite or observable symptoms, whereas some infections cause severe symptoms, require hospitalization or may be life-threatening. Some infections are localized, whereas some may overcome the body through blood circulation or lymphatic vessels Some infections have long-term effects on wellbeing of infected individuals.

Infectious agents may be transmitted to humans via different routes. For example, infection agents may be transmitted by direct contact with an infected human, an infected animal, or an infected surface Infections may be transmitted by direct contact with bodily fluids of an infected human or an animal, e.g. blood, saliva, sweat, tears, mucus, female ejaculate, semen, vomit or urine. For example, infection may be transmitted by a fecal-oral route, referring to an infected person shedding the virus in fecal particles which then enters to person's mouth causing infection. The fecal-oral route is especially common transmission route in environments with poor sanitation and hygiene. Non-limiting examples of agents transmitted by the fecal-oral route include bacteria, e.g. shigella, *Salmonella typhii* and *Vibrio Cholerae*, virus, e.g. norovirus, rotavirus, enteroviruses, and hepatitis A, fungi, e.g. *Entamadeba histolytica*, parasites, tape worms, transmitted by contaminated food or beverage, leading to food poisoning or gastroenteritis. Infections may be transmitted by a respiratory route, referring to agents that are spread through the air. Typical examples include agents spread as small droplets of liquid or as aerosols, e.g. respiratory droplets expelled from the mouth and nose while coughing and sneezing. Typical examples of respiratory transmitted diseases include the common cold mostly implicated to rhinoviruses, influenza caused by influenza viruses, respiratory tract infections caused by e.g. respiratory syncytial virus (RSV). Infections may be transmitted by a sexual transmission route. Examples of common sexually transmitted infections include e.g. human immunodeficiency virus (HIV) causing acquired immune deficiency syndrome (AIDS), chlamydia caused by *Neisseria gonorrhoeae* bacteria, fungal infection Candidiasis caused by Candida yeast, and Herpes Simplex disease caused by herpes simplex virus Infections may be transmitted by an oral transmission route, e.g. by kissing or sharing a drinking glass. A common infection transmitted by oral transmission is an infectious mononucleosis caused by Epstein-Barr virus Infections may be transmitted by a vertical transmission, also known as "mother-to-child transmission." from mother to an embryo, fetus or infant during pregnancy or childbirth. Examples of infection agents that may be transmitted vertically include HIV, chlamydia, rubella, *Toxoplasma gondii*, and herpes simplex virus. Infections may be transmitted by an iatrogenic route, referring to a transmission by medical procedures such as injection (contaminated reused needles and syringes), or transplantation of infected material, blood transfusions, or infection occurring during surgery. For example, methicillin-resistant *Staphylococcus aureus* (MRSA), which may cause several severe infections, may be transmitted via iatrogenic route during surgery. Infections may also be transmitted by vector-borne transmission, where a vector may be an organism transferring the infection agents from one host to another. Such vectors may be triatomine bugs, e.g. trypanosomes, parasites, animals, arthropods including e.g. mosquitos, flies, lice, flees, tick and mites or humans. Non-limiting examples of mosquito-borne infections include Dengue fever, West Nile virus related infections, Yellow fever and Chikungunya fever. Non-limiting examples of parasite-borne diseases include malaria, Human African trypanosomiasis and Lyme disease. Non-limiting examples of diseases spread by humans or mammals include HIV. Ebola hemorrhagic fever and Marburg fever.

Traditionally infectious diseases are treated with medications and/or good supportive care. Medical prevention, treatment and/or management of bacterial infections may include administration of antibiotics. Antibiotics may inhibit the colonization of bacteria or kill the bacteria. Antibiotics include e.g. penicillins, cephalosporins, macrolides, fluoroquinolones, sulfonamides, tetracyclines, and aminoglycosides. Antibiotics may be specific to a certain bacteria or act against broad spectrum of bacteria. Some types of bacteria are especially susceptible to antibiotics, whereas some bacteria are more resistant. Development of bacterial strain mutations that are resistant to antibiotics is an increasing concern. Methicillin-resistant *Staphylococcus aureus* (MRSA), vancomycin-resistant *Enterococcus* (VRE), multi-drug-resistant *Mycobacterium tuberculosis* (MDR-TB) and *Klebsiella pneumoniae* carbapenemase-producing bacteria (KPC) are examples of bacteria that are resistant to most general antibiotics. Due to the emerging resistance, unnecessary administration and overdosing of antibiotics should be avoided. Medical prevention, treatment and/or management of viral infections may include administration of antiviral medications. Antiviral medications may be specific to a certain bacteria or act against a broad spectrum of viruses. Currently antiviral medications are available for e.g. HIV, influenza, hepatitis B and C Medical prevention, treatment and/or management of viral infections may include administration of antifungal medication. Antifungal medication kills or prevents the growth of fungi. Types of antifungal medications include e.g. imidazoles, triazoles and thiazoles, allylamines, and echinocandins. Development of antifungal medication capable of targeting fungal cells without affecting human cells is a challenge due to the similarities of human and fungal cell on the molecular level. Typically, medical treatment is combined with good supportive care, which includes provision of fluids, bed rest, medication to relieve pain and lower fever, supportive alternative medicine such as vitamins, antioxidants and other supplements important for wellbeing of patients.

Antibody therapies for infectious diseases have also been developed. Examples of commercial therapeutic antibodies include raxibacumab (developed by Cambridge Antibody Technology and Human Genome Sciences) which is an antibody for the prophylaxis and treatment of inhaled anthrax. SHIGAMAB™ (developed by Bellus Health Inc.) is a monoclonal antibody for treatment of Shiga toxin induced hemolytic uremic syndrome, and actoxumab and bezlotoxumab (developed by Medarex Inc, and the University of Massachusetts Medical School) are commercial human monoclonal antibodies targeting *C. difficile* toxin A and toxin B, respectively.

Infectious diseases and/or infection related diseases, disorders, and/or conditions that may be treated by methods, components and compositions of the present invention include, but are not limited to, 14-day measles, 5-day fever, acne, acquired immunodeficiency syndrome (AIDS), acrodermatitis chronica atrophicans (ACA), acute hemorrhagic conjunctivitis, acute hemorrhagic cystitis, acute rhinosinusitis, adult T-cell leukemia-lymphoma (ATLL). African sleeping sickness, alveolar hydatid, amebiasis, amebic meningoencephalitis, anaplasmosis, anthrax, arboviral, ascariasis, aseptic meningitis, Athlete's foot, Australian tick typhus, avian Influenza, babesiosis, bacillary angiomatosis, bacterial meningitis, bacterial vaginosis, balanitis, balantidiasis, Bang's disease, Barmah Forest virus, bartonellosis, bat lyssavirus, Bay sore, Baylisascaris, beaver fever, beef tapeworm, bejel, biphasic meningoencephalitis, black bane, black death, black piedra, Blackwater fever, blastomycosis, blennorrhea of the newborn, blephantis, boils, Bomholm disease, borrelia miyamotoi disease, botulism, boutonneuse fever, Brazilian purpuric fever, break bone fever, brill, bronchiolitis, bronchitis, brucellosis, bubonic, bubonic plague, bullous impetigo, *Burkholderia mallei, Burkholderia pseudomallei*, burly ulcers mycoburuli ulcers, Busse-Buschke disease, California group encephalitis, campylobacteriosis, candidiasis, canefield fever, canicola fever, capillariasis, carate, carbapenem-resistant enterobacteriaceae (CRE), Carrion's disease, cat scratch fever, cave disease, central Asian hemorrhagic fever, Central European tick, cervical cancer, Chagas disease, cancroid, Chicago disease, chickenpox, Chiclero's ulcer, chikungunya fever, chlamydial, cholera, chromoblastomy cosis, ciguatera, clap, clonorchiasis, *Clostridium difficile, Clostridium perfringens*, coccidioidomycosis fungal, coenurosis, colorado tick fever, condyloma accuminata, condyloma lata, Congo fever, Congo hemorrhagic fever virus, conjunctivitis, cowpox, crabs, Crimean disease, croup, crypto, cryptococcosis, cryptosporidiosis, cutaneous larval migrans, cyclosporiasis, cystic hydatid, cysticercosis, cystitis, Czechoslovak tick, d68 (EV-d68), dacnrocytitis, dandy fever, darling's disease, deer fly fever, dengue fever types 1, 2, 3, and 4, desert rheumatism, devil's grip, diphasic milk fever, diphtheria, disseminated intravascular coagulation, dog tapeworm, donovanosis, dracontiasis, dracunculosis, duke's disease, dum dum disease, Durand-Nicholas-Favre disease, dwarf tapeworm, *E. coli*, eastern equine encephalitis, Ebola hemorrhagic fever, Ebola virus disease (EVD), ectothrix, ehrlichiosis, encephalitis, endemic relapsing fever, endemic syphilis, endophthalmitis, endothrix, enterobiasis, enterotoxin-B poisoning (staph food poisoning), enterovirus, epidemic keratoconjunctivitis, epidemic relapsing fever, epidemic typhus, epiglottitis, epsilon toxin, erysipelas, erysipeloid, erysipelothricosis, erythema chronicum migrans, erythema infectiosum, erythema marginatum, erythema multiforme, erythema nodosum, erythema nodosum leprosum, erythrasma, espundia, eumycotic mycetoma, European blastomycosis, exanthem subitum, eyeworm, Far-Eastern tick, fascioliasis, fievre boutonneuse, fifth disease, Filatow-Dukes' disease, fish tapeworm, Fitz-Hugh-Curtis syndrome—perihepatitis, flinders island spotted fever, flu, folliculitis, four corners disease, frambesia, francis disease, furunculosis, gas gangrene, gastroenteritis, genital herpes, genital warts, German measles, Gerstmann-Straussler-Scheinker (GSS), giardiasis, Gilchrist's disease, gingivitis, gingivostomatitis, glanders, glandular fever, gnathostomiasis, gonococcal, gonorrhea, granuloma inguinale, guinea worm, haemophilus influenza disease, hamburger disease, Hansen's disease, Hantaan disease, Hantaan-Korean hemorrhagic fever, hantavirus pulmonary syndrome (UPS), hard chancre, hard measles, Haverhill fever, head and body lice, heartland fever, helicobacterosis, hemolytic uremic syndrome (HUS), hepatitis A, hepatitis B, hepatitis C, hepatitis D, hepatitis E, herpangina, herpes—genital, herpes labialis, herpes—neonatal, hidradenitis, histoplasmosis, histoplasmosis, his-werner disease, hiv, hookworms, hordeola, HTLV-associated myelopathy (HAM), human granulocytic ehrlichiosis, human monocytic ehrlichiosis, human papillomarivus (HPV), human pulmonary syndrome, human pulmonary syndrome (HPS), human T-cell lymphotrophic virus (HTLV), hydatid cyst, hydrophobia, impetigo, including congenital, inclusion conjunctivitis, infantile diarrhea, infectious mononucleosis, infectious myocarditis, infectious pericarditis, influenza, isosporiasis, Israeli spotted fever, Japanese encephalitis, jock itch, jorge lobo disease, jungle yellow fever, Junin Argentinian hemorrhagic fever, kala azar, Kaposi's sarcoma, keloidal blastomycosis, keratoconjunctivitis, kuru, Kyasanur forest disease, lacrosse encephalitis, lassa hemorrhagic fever, legionellosis, legionnaires disease, legionnaire's pneumonia, Lemierre's syndrome, lemming fever, leprosy, leptospirosis, listena, listeriosis, liver fluke, lobo's mycosis, lock jaw, lockjaw, loiasis, louping ill, Ludwig's angina, lung fluke, Lyme disease, lymphogranuloma venereum (LGV), Machupo Bolivian hemorrhagic fever, Madura foot, mal del pinto, malaria, malignant pustule, Malta fever, Marburg hemorrhagic fever, masters disease, maternal sepsis, measles, Mediterranean spotted fever, melioidosis, meningitis, meningococcal disease, Middle East Respiratory Syndrome (MERS), methicillin-resistant *Staphylococcus aureus* (MRSA), milker's nodule, molluscum contagiosum, moniliasis, monkeypox, mononucleosis, mononucleosis-like syndrome, Montezuma's revenge, morbilli, mucormycosis, multiple organ dysfunction syndrome (MODS), multiple-system atrophy (MSA), mumps, murine typhus, Murray Valley encephalitis (MVE), mycoburuli ulcers, mycotic vulvovagmitis, myositis, Nanukayami fever, necrotizing fasciitis, necrotizing fasciitis—type 1, necrotizing fasciitis—type 2, negishi, new world spotted fever, nocardiosis, nongonococcal urethritis, non-polio enterovirus, norovirus, North American blastomycosis, North Asian tick typhus, Norwalk virus, Norwegian itch, O'hara disease, Omsk hemorrhagic fever, onchoceriasis, onychomycosis, opisthorchiasis, opthalmia neonatorium, oral hairy leukoplakia, orf, oriental sore, oriental spotted fever, omithosis, Oroya fever, otitis externa, otitis media, pannus, paracoccidioidornycosis, paragonimiasis, paramfectious, paralytic shellfish poisoning, paronychia, parotitis, parrot fever, pediculosis, peliosis hepatica, pelvic inflammatory disease, pertussis, phaeohyphomycosis, pharyngoconjunctival fever, piedra, pigbel, pink eye conjunctivitis, pinta, pinworm, pitted keratolysis, pitvriasis versicolor, plague, pleurodynia, pneumococcal disease, pneumocystis pneumonia, pneumocystosis, pneumonia, polio, poliomyelitis, polycystic hydatid, Pontiac fever, pork tapeworm, Posada-Wernicke disease, postanginal septicemia, Powassan, progressive multifocal leukencephalopathy (PML), progressive rubella panencephalitis, prostatitis, pseudomembranous colitis, psittacosis, puerperal fever, pustular rash diseases, pyelonephritis, pylephlebitis, q-fever, quinsy, quintana fever, rabbit fever, rabies, racoon roundworm, rat bite fever, rat tapeworm, Reiter syndrome, relapsing fever, respiratory syncytial virus (RSV), rheumatic fever, rhodotorulosis, ricin poisoning, rickettsialpox, rickettsiosis, Rift valley fever, ringworm, Ritter's disease, river blindness, rocky mountain spotted fever, rose handler's disease, rose rash of infants, roseola, Ross river fever, rotavirus, roundworm s, rubella, rubeola, Russian spring, salmonellosis gastroenteritis, San Joaquin valley fever, Sao Paulo encephalitis, Sao Paulo fever, scabies infestation, scalded skin syndrome, scalded skin syndrome, scarlatina, scarlet fever, schistosomiasis, scombroid, scrub typhus, sennetsu fever, sepsis, septic shock, severe acute respiratory syndrome, severe acute respiratory syndrome (SARS), shiga toxigenic *Escherichia coli*, shigella, shigellosis gastroenteritis, shinbone fever, shingles, shipping fever, siberian tick typhus, sinusitis, sixth disease, slapped cheek disease, sleeping sickness, small pox, smallpox, snail fever, soft chancre, southern tick associated rash illness, sparganosis, Spelunker's disease, sporadic typhus, sporotrichosis, spotted fever, spring, St. Louis encephalitis, staphylococcal food poisoning, staphylococcal, strep, throat, streptococcal disease, streptococcal toxic-shock syndrome, strongyloiciasis, stye, subacute sclerosing panencephalitis (SSAPE), sudden acute respiratory syndrome, sudden rash, swimmer's ear, swimmer's itch, swimming pool conjunctivitis, Sylvatic yellow fever, syphilis, systemic inflammatory response syndrome (SIRS), tabes dorsalis, taeniasis, taiga encephalitis, tanner's disease, tapeworm s, temporal lobe encephalitis, tertiary syphilis, tetani, tetanus, threadworms, thrush, tick, tick typhus, tinea barbae, tinea capitis, tinea corporis, tinea cruris, tinea manuum, tinea nigra, Tinea pedis, tinea unguium, tinea versicolor, torulopsosis, torulosis, toxic shock syndrome, toxoplasmosis, transmissible spongioform, traveler's diarrhea, trench fever 5, trichinellosis, trichomoniasis, trichonycosis axillaris, trichuriasis, tropical spastic paraparesis (TSP), trypanosomiasis, tuberculosis (TB), tularenua, typhoid fever, typhus fever, ulcus molle, undulant fever, urban yellow fever, urethritis, vagmitis, vaginosis, valley fever, vancomycin intermediate (VISA), vancomycin resistant (VRSA), varbuncle, varicella, variola, varrion's disease, venezuelan equine encephalitis, Verruga peruana, vibrio, *Vibrio cholerae*, vibriosis, vincent's disease or trench mouth, viral conjunctivitis, viral meningitis, viral meningoencephalitis, viral rash, visceral larval migrans, vomito negro, vulvovaginitis, warts, Waterhouse, Weil's disease, West Nile fever, Western equine encephalitis, Whipple's disease, whipworm, white piedra, whitlow, Whitmore's disease, whooping cough, winter diarrhea, wolhynia fever, wool sorters' disease, yaws, yellow fever, yersinosis, zahorsky's disease, zika virus disease, zoster, zygomycosis, acute bacterial rhinosinusitis, lobomycosis, and/or any other infectious diseases, disorders or conditions.

John Cunningham Virus (JCV)

John Cunningham Virus is a common human polyomavirus. The transmission route of JCV is unknown. The virus is suspected to be spread by contaminated water and may be obtained through tonsils or by the gastrointestinal tract, 70-90% of humans are estimated to be infected by the virus, and for normal healthy individuals the infection is asymptomatic. However, for patients with weakened immune system. JCV may lead to Progressive multifocal leukoencephalopathy (PMI). PML is a condition characterized by multifocal progressive damage or inflammation of the white matter of the brain. The symptoms include clumsiness, progressive weakness and changes in visual, speech and personality. PLM has a mortality rate of 30-50% and patients who survive the disease are left with severe neurological disabilities. PML occurs in patients with a severe immunodeficiency, most commonly in patients with HIV/AIDS. As many as 5% of HIV/AIDS patients are affected by PML. Individuals with other autoimmune conditions such as multiple sclerosis, rheumatoid arthritis, and systemic lupus erythematosus are also at risk, as well as individuals going through immunosuppressive therapy for cancer, e.g lymphoma or Hodgkin's disease, or organ transplant. PML associated with immunosuppressive therapy is an increasing concern. For example, commercial antibody natalizumab (TYSABR®, developed by Biogen Idec) for treatment of multiple sclerosis increases susceptibility to PML. Other drugs associated with increased risk of PML include Rituximab (RITUXAN®, developed by IDEC Pharmaceuticals), Efalizunab (RAPTIVAR® developed by Genentech and XOMA) and Mycophenolate mofetil (CELLCEPT®, developed by Genentech).

JCV is a nonenveloped, T=7 icosahedral virus with a closed circular, double-stranded DNA genome. The major capsid component is the viral protein VP1 is made of 72 pentamers formed by VP1 monomers linked through the C terminal end. VP1 starts the infection by binding to the receptor target cells. After initial infection, typically occurring in childhood or adolescence, the virus stays quiescent in the kidneys and the lymphoid organs. In healthy individuals, the virus may replicate in kidney without causing any symptoms. However, in patients with weakened immune system, JCV may cross the blood-brain barrier into the central nervous system causing PML.

As of today, there is no known cure for PML. Current therapies focus on reversing the immune deficiency to slow down or stop the progress of the disease. There remains a need for therapies neutralizing JVC for prevention, management and treatment of JCV infection and PML Goldmann et al. demonstrated that neutralizing activity with JCV VP1 protein in sera of a rabbit (see Goldmann C. et al., 1999, *J. Virol.*; 73(5): 4465-4469). Therapies based on neutralizing JCV antibodies could be applied for treatment, management and/or prevention of PML. Recently, immunological approaches have been under investigation and neutralizing antibodies binding to JC virus, especially targeting the VP1 protein, have been developed e.g. as described in US Patent Publication US2015/0191530. US2015/0056188 and US2015/0050271, the contents of each of which are incorporated herein by reference in their entirety. Such antibodies may cause reduction of JCV replication, proliferation or Infectivity. Antibodies may bind to a conformational epitope of JCV VP1 protein or to the sialic acid binding pocket of VP1 protein of JCV.

In some embodiments, methods of the present invention may be used to prevent, manage and/or treat JCV infection and/or PML.

AAV particles and methods of using the AAV particles described in the present invention may be used to prevent, manage and/or treat JCV As a non-limiting example, the AAV particles of the present invention comprise a nucleic acid sequence encoding at least one of the sequences described in Table 26 (SEQ ID NO: 6802-6865).

Influenza Virus

Influenza viruses cause a common respiratory infection called influenza (flu). Influenza viruses are categorized into three main groups, virus A, B and C Influenza viruses are negative-sense, single-stranded, segmented RNA viruses. Influenza A contains two proteins on the surface of the viral envelope; hemagglutinm (H), which is a protein responsible for red blood cell agglutination and neuraminidase (N), which is an enzyme cleaving the glycosidic bonds of neuraminic acid. Influenza A mutates at a faster rate than types B and C Several serotypes of H and subtypes of N have been identified. Influenza Type B, similarly to Type A, contains H and N protein. Type C influenza virus is a single stranded RNA virus with glycoprotein called hemagglutinin-esterase fusion Influenza strains vary according to geographical presentation.

Influenza in general is a highly contagious disease and may be transmitted by the respiratory route. Influenza symptoms include e.g. high fever, runny nose, headache, sore throat, muscle pain, cough and occasionally nausea and vomiting. Influenza may lead to other complications such as pneumonia or sinus infections. Influenza may be dangerous to young children, the elderly, pregnant women and individuals with chronic medical conditions or weakened immune system. According to Centers for Disease Control and Prevention (CDC), the estimated annual number of flu-associated deaths in the United States ranges between 3000 and 49,000, depending on the severity of the seasonal variations.

Influenza may be treated with good supportive care and antiviral medication. Antiviral medications include neuraminidase inhibitors, e.g. oseltamivir and zanarmvir and M2 protein inhibitors. However, some strains of influenza appear to be resistant to these antiviral medications. Seasonal vaccinations to influenza are very efficient in prevention of the disease and are recommended annually.

There remains a need for prevention and treatment therapies for influenza, especially for those providing long lasting and broad neutralization Therapeutic antibodies against influenza viruses have been developed. In general, antibody responses to different subtypes and serotypes of influenza A. B and C are unique. Some therapeutic antibodies are specific to an antibody type, whereas some have a broad coverage.

Navivumab (developed by Celltrion, Inc.) taught in US Patent application US20140234336, firivumab (developed by Celltrion, Inc.) taught in US Patent application US20130004505 and diridavumab (developed by Jansen Biotech, Crucell and Johnson&Johnson) taught in International Patent application WO/2008/028946 are examples of therapeutically antibodies against influenza A hemagglutinin HA.

AAV particles and methods of using the AAV particles described in the present invention may be used to prevent, manage and/or treat influenza. As a non-limiting example, the AAV particles of the present invention comprise a nucleic acid sequence encoding at least one of the sequences described in Table 21 (SEQ ID NO: 4138-5222).

Hepatitis

Hepatitis is an inflammation of the liver. Hepatitis may be caused by an infection of hepatitis viruses A, B, C, D or E. In some cases, hepatitis may be asymptotic. A typical symptom of hepatitis is jaundice, characterized by yellowing of the skin, mucous membrane and conjunctiva. Other symptoms include loss of appetite, diarrhea, nausea and fever. Hepatitis may lead to a liver failure. Acute form of hepatitis is healed within six months of infection. The inflammation may also progress to a chronic hepatitis, which may lead to liver complications such as fibrosis, cirrhosis or hepatocellular carcinoma. There is no specific treatment for hepatitis. Typically, acute hepatitis is treated with good supportive care, including good nutritional balance, fluid and rest. Chronic hepatitis may be treated with antiviral drugs. Hepatitis may be prevented by vaccinations.

Hepatitis A (HAV) virus belongs to the family of Picornaviridae. HAV is encapsidated in an icosahedral structure formed by 60 copies of three viral structural proteins (VP1, VP2 and VP3), (see e.g. Kim et al. 2004, *Virlogy;* 318(2): 598-607, and references therein). HAV is spread by the fecal-oral-route. Typical transmission is through contaminated food or drink or in contact with an infected individual. Improperly cooked shellfish is a common source of HAV. Hepatitis A is more abundant in developing countries with poor sanitary conditions. According to the World Health Organization (WHO), an estimated 1.4 million people are infected by HAV every year.

Vaccines for prevention of HAV infection exists and are recommended to be administered to children under 1 year of age by CDC, As of today, there is no specific treatment for HAV infection. The treatment includes supportive therapy and may last for weeks or even months. There remains a need for treatment therapies for HAV. Antibodies for prevention and/or treatment of HAV have been developed. For example, U.S. Pat. No. 763,476, International Publication WO2011114353 and Kim et al in Virology. 2004 Jan. 20:318(2).598-607, the contents of each of which are incorporated herein by reference in their entirety, teach neutralizing antibodies targeting HAV antigens.

Hepatitis B (HBV) belongs to the family of Orthohepadnaviridae. HBV comprises a 3.2 kb-partially double-stranded circular DNA genome. HBV virus may be transmitted via the sexual transmission route, vertical transmission at birth, iatrogenic route (e.g. blood transfusions, contaminated reused needles and syringes), as well as via exposure to certain body fluids of an infected individual According to the WHO, an estimated 240 million people are chronically infected with hepatitis B annually, and more than 780 000 people die to associated complications.

HBV may be prevented by vaccination. The WHO recommends vaccination for all infants, as well as for adults living in increased risk of the infection. HBV infection may be treated with antiviral medications, e.g. tenofovir and entecavir. The medication does not cure the disease but suppresses the replication of the virus. Individuals with chronic hepatitis B infection are administered antiviral medications for life. There remains a need for therapies providing long lasting management and/or cure for HBV infection. Antibodies for prevention and/or treatment of HBV infection are described e.g. in US Patent publication US20120308580 and International publication WO2013165972, the contents of each of which are herein incorporated by their reference in their entirety.

Hepatitis C (HCV) belongs to the family of Flaviviridae. HCV is a positive-sense single-stranded RNA virus with an open reading frame with 9600 nucleotide bases. HCV is most commonly transmitted by the sexual transmission route or iatrogenic route. Hepatitis C may be transmitted also via the vertical route, though uncommon. According to WHO, 130-150 million people have a chronic HCV infection and approximately half a million people die from complications associated with HCV annually.

As of today, there is no vaccine for HCV infection. Traditional treatment of hepatitis C is based on antiviral medication therapy with e.g. ribavirin and interferon. More recently, direct antiviral agents (DAA) have been developed to treat hepatitis C infections. However, there remains a need for efficient prevention and treatment therapies for HCV infection.

Hepatitis D (HDV) is a small spherical enveloped RNA virus belonging to the genus of deltaviruses. HDV infection may only replicate in the presence of a HBV virus and therefore HDV infection has a dependency on HBV. HDV virus may be transmitted as coinfection with HBV or be superimposed on chronic HBV or HBV carrier state. HDV may be transmitted similarly to HBV, e.g. via the sexual transmission route, vertical transmission at birth, iatrogenic route, as well as via exposure to certain body fluids of an infected individual. Treatment and vaccination against HBV may be applied against HDV, and there remains a need for therapies to cure both infections.

Hepatitis E (HEV) is a linear, monoparte, single-stranded RNA virus belonging to the family of Hepeviridae. HEV may be transmitted via the fecal-oral route due to contaminated food or beverage, the iatrogenic route (e.g. blood transfusions, contaminated reused needles and syringes) or the vertical transmission route during pregnancy. Contaminated drinking water is the most common source of infection. Improperly cooked shellfish are a common source of HEV. The disease is present worldwide but is more abundant in East and South Asia, and especially in environments with poor sanitation and hygiene. According to WHO, an estimated 20 million HEV infections occur annually leading to 56 600 death associated with HEV complications.

There is no specific treatment for HEV. The disease is typically cured with good supportive care. As of today, vaccinations against 1-HEV are not globally available, though development in the field has been done. There remains a need for prevention and treatment therapies for HEV infection. Antibodies for prevention and treatment of HEV have been developed. For example, neutralizing antibodies targeting HEV have been taught in U.S. Pat. No. 7,148,323, Tang et al. 2011. *Proc. Natl. Acad. Sci.* U.S.A. 108 (25), 10266-10271 and Gu et al. 2015, *Cell Res.* 25 (5), 604-620, the contents of each of which are incorporated herein by reference in their entirety.

In some embodiment, methods of the present invention may be used to prevent, manage and/or treat infections and complications caused by HAV, HBV, HCV, HDV and/or HEV.

AAV particles and methods of using the AAV particles described in the present invention may be used to prevent, manage and/or treat HAV. As a non-limiting example, the AAV particles of the present invention comprise a nucleic acid sequence encoding at least one of the sequences described in Table 6 (SEQ ID NO: 3197-3237).

AAV particles and methods of using the AAV particles described in the present invention may be used to prevent, manage and/or treat HBV. As a non-limiting example, the AAV particles of the present invention comprise a nucleic acid sequence encoding at least one of the sequences described in Table 23 (SEQ ID NO: 6311-6627).

AAV particles and methods of using the AAV particles described in the present invention may be used to prevent, manage and/or treat HDV. As a non-limiting example, the AAV particles of the present invention comprise a nucleic acid sequence encoding at least one of the sequences described in Table 23 (SEQ ID NO: 6311-6627).

AAV particles and methods of using the AAV particles described in the present invention may be used to prevent, manage and/or treat HEV. As a non-limiting example, the AAV particles of the present invention comprise a nucleic acid sequence encoding at least one of the sequences described in Table 6 (SEQ ID NO: 3197-3237).

Respiratory Syncytial Virus (RSV)

Respiratory syncytial virus (RSV) is a single-stranded RNA virus belonging to the family of Paramyxoviridae. The RSV RNA is contained in a nucleocapsid made of 11 proteins and covered with a lipid envelope (see, e.g. Piedimonte, 2015, *Cleve Clin J Med.;* 82(11 Suppl 1):S13-8, and references therein). RSV attaches to the epithelial cells of the host airway cells with the surface glycoproteins G and F and merges the viral envelope to the membranes of adjacent cells G and F glycoproteins are the principal antigens exposed to the host immune system.

Respiratory syncytial virus (RSV) causes infections of the respiratory tract including the lungs and breathing passages. RSV is transmitted through the respiratory transmission route, in direct contact with nasal or oral secretions of infected individuals, or indirectly e.g. by touching a contaminated surface. The symptoms include a runny nose, decrease of appetite, coughing, sneezing, fever and wheezing. The infection may progress into a pneumonia or bronchiolitis Additionally, RSV infection may have a role in triggering asthma attacks and in the inception of asthma for individuals with a family history of asthma. In healthy adults, RSV infection is typically mild and does not require hospitalization. However, the infection may be dangerous for young children and infants, and for individuals with a weakened immune system. According to the CDC, almost all children under 3 years of age will acquire an RSV infection and up to 2% of cases require hospitalization. RSV infection the most common cause for bronchiolitis and pneumonia in children younger than 1-year-old.

As of today, there is no specific medical treatment for RSV infection on the market and typically the infection is treated with good supportive care. There remains a need for prevention and treatment therapies for RSV infections and associated complications. Antibodies for treatment and prevention of RSV infection have been developed. For example, palivizumab (developed by Medimmune) taught in U.S. Pat. No. 8,153,133, the contents of which are incorporated herein by reference in their entirety, is a nearly human monoclonal antibody targeting the RSV F glycoprotein. Palivizunumab is used for passive immunity for infants at risk for severe infection, including children with hemodynamically significant congenital heart defects, profound immunodeficiency and pulmonary or neuromuscular pathologies impairing airway clearance.

In some embodiment, methods of the present invention may be used to prevent, manage and/or treat infections and complications caused by RSV.

AAV particles and methods of using the AAV particles described in the present invention may be used to prevent, manage and/or treat RSV As a non-limiting example, the AAV particles of the present invention comprise a nucleic acid sequence encoding at least one of the sequences described in Table 22 (SEQ ID NO: 5223-6310).

Herpes Simplex Virus 1 and 2

Herpes simplex viruses 1 and 2 (HSV1 and HSV2), also known as human herpesvirus 1 and 2 (HHV-1 and HHV-2), belong to the family of Herpesviridae. Herpesviruses in general, consist of an icosahedral capsid surrounded by a membrane envelope. The capsid contains the viral double stranded DNA. The capsid is surrounded by an amorphous tegument of 30 viral proteins. The virion is enveloped by lipids with multiple viral glycoproteins and cellular proteins (see, e.g. McAllister and Schleiss, 2014, *Expert Rev Vaccines.;* 13(11):1349-1360, and references therein).

HSV1 and HSV2 cause an infection known as herpes, which is characterized by blisters in the skin, or mucous membranes of the mouth, lips, also known as "cold sores", or genitals. Typically, the symptoms are mild or asymptomatic. However, HSV1 and HSV2 are neurotropic and neuroinvasive viruses persisting in the body by becoming latent, and sustain in the cell bodies of neurons. The infection is lifelong with outbreaks, or sporadic episodes of viral reactivation, when the virus in the nerve cells become active causing new blistering. The infection may be dangerous to individuals with weakened immune system. Neonatal herpes of infants may be fatal. Occasionally HSV1 infections may lead to encephalitis or keratitis. HSV1 and HSV2 are transmitted by contact with an infected area during reactivations of the virus. HSV1 is mainly transmitted by oral-to-oral contact, skin contact or the sexual transmission route. HSV1 may also be transmitted vertically during birth. HSV2 is transmitted via the sexual transmission route and is one of the most common sexually transmitted infections. According to the WHO, an estimated 67% of world's population aged under 50 years has an HSV-1 infection. An estimated 11% of world's population aged 15-49 years has an HSV2 infection.

As of today, there is no vaccination for prevention of HSV1 and HSV2 infections on the market. HSV1 and HSV2 infections may be treated with antiviral medications, such as acyclovir, famciclovir and valacyclovir. Antiviral medications do not cure the infection, but reduce the severity and frequency of symptoms. There remains a therapy for prevention and cure for these infections. Antibodies for prevention, treatment and management of HSV1 and HSV2, targeting the viral glycoproteins, have been developed, as described e.g. in U.S. Pat. No. 8,431,118, US Patent U.S. Pat. No. 5,646,041. Haynes US Patent Publication US201410302062, the contents of each of which are incorporated herein by reference in their entirety.

In some embodiment, methods of the present invention may be used to prevent, manage and/or treat infections and complications caused by HSV1 and HSV2.

AAV particles and methods of using the AAV particles described in the present invention may be used to prevent, manage and/or treat HSV. As a non-limiting example, the AAV particles of the present invention comprise a nucleic acid sequence encoding at least one of the sequences described in Table 24 (SEQ ID NO: 6628-6736).

Human Cytomegalovirus

Human Cytomegalovirus (HCMV) also known as human herpesvirus 5 (HHV-5) belongs to the family of Herpesviridae, a sub-family of Betaherpesvirinae. HCMV is a double-stranded DNA enveloped virus composed of a nucleocapsid surrounded by structured tegument layer and bounded by a trilaminate membrane envelope.

In most occasions, an initial HCMV infection is asymptomatic, or associated with mild symptoms e.g. sore throat, fatigue, flu-like symptoms, and fever. After initial infections, HCMV virus resides in mononuclear cells without detectable symptoms. HCMV infection may be dangerous to individuals with weakened immune system. HCMV may be transmitted by contact with certain body fluids of an infected individuals (e.g. saliva, urine, semen). HCMV may be transmitted vertically, especially if acquired during pregnancy, leading to a congenital HCMV infection. According to CDC, about 1 in 150 children are born with congenital CMV infection. In about 20% of cases, congenital HCMV infection may lead to premature birth, birth defects or developmental disabilities, e.g. liver, lung, spleen problems, small head size, small body size or seizures.

As of today, there is no specific treatment or prevention therapy for HCMV infection. In severe cases of congenital HCMV infection, infants may be treated with an antiviral drug, ganciclovir, to prevent hearing loss and developmental outcomes. However, the drug has serious side effects. There remains a need for prevention therapy and improved therapies for treatment and cure of HCMV infection. Antibodies neutralizing HCMV have been developed. Such antibodies are taught e.g. in International Patent Publication WO2010007463, U.S. Pat. Nos. 9,149,524, 8,492,529 and 8,202,518, the contents of each of which are incorporated herein by reference in their entirety.

In some embodiment, methods of the present invention may be used to prevent, manage and/or treat infections and complications caused by HCMV.

AAV particles and methods of using the AAV particles described in the present invention may be used to prevent, manage and/or treat HCMV. As a non-limiting example, the AAV particles of the present invention comprise a nucleic acid sequence encoding at least one of the sequences described in Table 24 (SEQ ID NO: 6628-6736).

Epstein-Barr Virus

Epstein-Barr virus (EBV), also known as human herpesvirus 4 (HHV-4) belongs to the family of Herpesviridae. EBV is a double-stranded DNA virus composed of a protein nucleocapsid surrounded by a tegument layer and bounded by an envelope containing lipids and surface projection of glycoproteins. EBV may enter B cells and epithelial cells.

EBV infection causes glandular fever known as infectious mononucleosis, also known as the kissing disease. Typical symptoms include e.g. sore throat, fever swollen lymph nodes in the neck, enlarged spleen, swollen liver, rash and fatigue. Additionally, EBV infection is associated with certain cancers, e.g. central nervous system lymphomas. Hodgkin's lymphoma, Burkitt's lymphoma, Guillain-Barre syndrome, multiple sclerosis, and higher susceptibility to certain autoimmune diseases. The virus is transmitted via contact with certain bodily fluids of an infected individual, especially through saliva. The infection affects majority of population. According to CDC, 90% of adult population have antibodies demonstrating current or past EBV infection.

As of today, there is no specific therapy for prevention or treatment of EBV infection on the market Typically, EBV infection is treated with good supportive care. Antibodies for prevention, management and treatment of EBV infection and associated diseases have been developed, e.g. by Wang and Fogg in US Patent publication US20150064174 and Fang et al, in *Intervirology* 50 (4), 254-263 (2007), the contents of each of which are incorporated herein by reference in their entirety.

In some embodiment, methods of the present invention may be used to prevent, manage and/or treat infections and complications caused by EBV.

AAV particles and methods of using the AAV particles described in the present invention may be used to prevent, manage and/or treat EBV. As a non-limiting example, the AAV particles of the present invention comprise a nucleic acid sequence encoding at least one of the sequences described in Table 31 (SEQ ID NO: 6898-6911).

Varicella Zoster Virus

Varicella zoster virus (VZV), also known as human herpes virus 3 (HHV-3) and chickenpox virus, belongs to the family of Herpesviridae. VZV is a linear duplex DNA molecule containing two segments (L and S) joined covalently. At least five clades of the virus have been identified.

VZV causes varicella, also known as chickenpox, which is an infection characterized by blister-like rash, itching, fatigue and fever. Chickenpox may be dangerous for babies, adults and individuals with weakened immune system. After primary phase of the infection, VZV resides in the nerves, including cranial nerve ganglia, dorsal root ganglia and autonomic ganglia, and may eventually lead to shingles, which is a viral disease characterized with a painful skin rash, blistering and occasionally nerve pain. Additionally, VZV has been associated with other complications, e.g. neurological conditions, inflammation of arteries, myelitis, Ramsay Hunt syndrome. Mollaret's meningitis VZV is transmitted by direct contact or by the respiratory route. VZV is highly contagious. According to CDC, before VZV vaccination, about 4 million people would be affected by chickenpox in the US annually, with more than 10,00KK hospitalized.

VZV infection may be prevented by a vaccination, which is recommended by CDC to all children and unvaccinated adults. Chickenpox may be treated with antiviral medications, e.g. acyclovir, valacyclovir and famciclovir, or with other symptom relieving medications and therapies. However, the present antiviral medications may have undesirable side effects. There remains a need for improved therapies to treat VZV infection, and its reactivation stages Antibodies targeting VZV have been developed, e.g. as described in U.S. Pat. No. 5,506,132, and US Patent application US20100074906, the contents of which are herein incorporated by their reference in their entirety.

In some embodiment, methods of the present invention may be used to prevent, manage and/or treat infections and complications caused by VZV.

AAV particles and methods of using the AAV particles described in the present invention may be used to prevent, manage and/or treat VZV. As a non-limiting example, the AAV particles of the present invention comprise a nucleic acid sequence encoding at least one of the sequences described in Table 31 (SEQ ID NO: 6898-6911).

Corona Viruses

Coronaviruses are a diverse group of enveloped viruses belonging to the family of Coronaviridae. Coronaviruses contain an envelope, a helical capsid, and a single-stranded, positive-sense RNA genome. Coronaviruses have a characteristic structure with viral spike-shaped glycoprotein populating the surface of the virus and causing an appearance resembling the solar corona. Coronaviruses are a common cause of mammalian and avian infections causing upper respiratory tract, gastrointestinal and central nervous system diseases.

Human coronavirus 229E, OC-43, NL63, and HKU1 are a cause a behind typical, short term 'common cold' and affect individuals all over the world. Typical symptoms of the infections include coughing, sneezing, fatigue and fever. Occasionally the viruses can cause lower-respiratory tract illnesses, such as pneumonia. The viruses are spread by direct contact or by the respiratory route. The infections may be dangerous to the elderly and individuals with weakened immune system. There is no specific treatment or prevention therapy for these coronavirus infections.

Severe Acute Respiratory Syndrome coronavirus (SARS-CoV) causes a viral respiratory illness. Typical symptoms of the infection include a high fever, headache, body aches, dry coughing and eventually pneumonia SARS-CoV was identified in 2003 in an outbreak starting from Asia. SARS-CoV is transmitted by direct contact with an infected individual or by the respirator route. According to the WHO, during the 2003 outbreak of SARS-CoV, 8098 people worldwide were infected with symptoms and out of them, 774 died. As of today, there is no specific treatment or prevention therapy for SARS on the market. Antiviral medication and steroids may be prescribed to certain patients. Antibodies targeting SARS-CoV have been developed, e.g. as described in U.S. Pat. No. 7,728,110 and US Patent publication US20110159001, the contents of each of which are herein incorporated by their reference in their entirety.

Middle East Respiratory syndrome coronavirus (MERS-CoV) causes an acute severe respiratory infection affecting the lungs and breathing tubes. MERS-CoV was identified in 2012. Typical symptoms include fever, cough and shortness of breath, eventually pneumonia and additionally gastrointestinal symptoms. MERS-CoV is highly dangerous to humans. According to the WHO, 36% of the infections are fatal. MERS-CoV is a zoonotic virus transmitted to humans from animals, e.g. bats and camels, or from human to human Camels are suggested to be a reservoir for MERS-CoV. Majority of MERS-CoV infection have occurred in the Arabian Peninsula, and especially in Saudi Arabia. As of today, no specific treatment of prevention therapy for MERS-CoV infection is available on the market. Antibodies targeting MERS-CoV have been developed, e.g. as described in International publication WO2015057942, the contents of which are herein incorporated by their reference in their entirety.

In some embodiment, methods of the present invention may be used to prevent, manage and/or treat infections and complications caused by SARS-CoV. MERS-CoV and/or other coronaviruses.

AAV particles and methods of using the AAV particles described in the present invention may be used to prevent, manage and/or treat coronaviruses. As a non-limiting example, the AAV particles of the present invention comprise a nucleic acid sequence encoding at least one of the sequences described in Table 25 (SEQ ID NO: 6737-6801).

Poxviruses

Poxviruses affecting humans include orthopoxvirus, parapoxvirus, yatapoxvirus and mollusipoxvirus. Poxviruses are typically brick-shaped, enveloped, single, liner or double-stranded viruses with DNA genome. Typically, poxvirus infections cause lesions, skin nodules, or disseminated rash Poxviruses may be transmitted by direct contact with contaminated humans, animals or materials. Diseases caused by poxviruses include e.g. smallpox, monkeypox, molluscum conagiosum, vaccinia virus and orf virus infection.

Smallpox virus infection is highly fatal, and though it does not occur in nature anymore, smallpox virus is considered to be a potential chemical or biological warfare agent. The threat of terrorism has created a need for efficient and improved methods for treatment and/or prevention of smallpox infection. The traditional vaccination for smallpox, also applicable against monkeypox, has a rare but severe side effect due to vaccinia virus, which is the active constituent of the vaccine that eradicated smallpox. Vaccinia Immune Globulin (VIG) is the only licensed therapeutic treatment for smallpox, but is highly variable and available in limited quantities Antibodies against smallpox have been developed, as described e.g. in U.S. Pat. No. 8,623,370 and US Patent publication US20140186370, the contents of each of which are herein incorporated by their reference in their entirety.

In some embodiment, methods of the present invention may be used to prevent, manage and/or treat infections and complications caused by smallpox virus and/or other poxviruses.

AAV particles and methods of using the AAV particles described in the present invention may be used to prevent, manage and/or treat poxvirus. As a non-limiting example, the AAV particles of the present invention comprise a nucleic acid sequence encoding at least one of the sequences described in Table 27 (SEQ ID NO: 6866-6875).

Enterovirus 71

Enterovirus 71 (EV71) belongs to the family of Picornaviridae Enterovirus 71 is a single-stranded RNA positive sense virus. The virus has approximately 7411 nucleotides. The RNA genome is enclosed in an icosahedral capsid of structural proteins VP1-VP4. (see, e.g. Tan et al., 2014, *J. Biomed Sci;* 21(1):140, and references therein).

EV71 infections typically cause hand, foot and mouth (HFMD), which is characterized by fever, mouth ulcers, and vesicles on the palms of the hands and feet. Additionally, EV7 causes severe neurological manifestations, including poliomyelitis-like acute flaccid paralysis, brainstem encephalitis in infants and children. These neurological manifestations may be fatal, or cause permanent neurological consequences, such as delayed neurodevelopment or reduced cognitive function in children. EV71 is transmitted through direct contact with certain bodily fluids, such as saliva, or the respiratory route, or the fecal-to-mouth route. Outbreaks of EV71 have been reported by WHO in the US, Europe, and more frequently in Asia-Pacific region in the past 30 year.

As of today, no specific treatment or prevention therapy for EV71 is on the market. Antiviral drugs, e.g. pleconaris and other capsid-function inhibitors (see, e.g. Tan et al J Biomed Sci. 2014; 21(1): 140), may be prescribed against EV71 infections, though their effectiveness is not well established. There remains a need for prevention and treatment therapies for EV71 infection. Antibodies neutralizing EV71 have been developed. Non-limiting examples include the anti-EV71 antibody MAB979 (developed by Merck Millipore) and those taught by Carderosa et al. in International Patent Publication WO2015092668, the contents of which are incorporated herein by reference in their entirety.

In some embodiment, methods of the present invention may be used to prevent, manage and/or treat infections and complications caused by EV71.

AAV particles and methods of using the AAV particles described in the present invention may be used to prevent, manage and/or treat EV71. As a non-limiting example, the AAV particles of the present invention comprise a nucleic acid sequence encoding at least one of the sequences described in Table 28 (SEQ ID NO: 6876-6891).

Rubella Virus

Rubella virus belongs to the family of Togaviridae. Rubella virus is a positive sense, single-stranded RNA virus with spike-like, hemagglutinin containing surface projections. The virus core is enveloped by glycosylated E1 and E2 proteins.

Rubella, also known as German measles or three-day measles, is a viral infection typically characterized by a rash, low fever, nausea, swollen lymph glands behind the ears and the neck, and mild conjunctivitis. At later stage, the infection may develop arthritis and pain in the joints. Typical symptoms of rubella infection are mild and affect children and young adults. Rubella virus is transmitted by the respiratory route and the virus replicates in the nasopharyngeal mucosa and local lymph nodes. However, when an infection is acquired during pregnancy, the virus is transmitted through vertical route with 90% chance and may cause fetal death or congenital defects known as congenital rubella syndrome (CRS). Infants with CRS may have hearing impairments, eye and heart defects, diabetes mellitus, thyroid dysfunction and/or autism. According to the WHO, about 10,000 infants with CRS are born every year, majority occurring in countries with low vaccine coverage.

As of today, there is no specific treatment for rubella. Rubella may be prevented with vaccination, and rubella has been part of the vaccination program for the past 40 years. However, the infection still persists and an increasing concern related to the life-time of vaccine efficiency exists. There remains a need for long lasting prevention therapy, as well as treatment for rubella virus infection. Antibodies against rubella have been described e.g. in US Patent US20100143376, the contents of each of which are herein incorporated by reference in their entirety.

In some embodiment, methods of the present invention may be used to prevent, manage and/or treat infections and complications caused by rubella.

AAV particles and methods of using the AAV particles described in the present invention may be used to prevent, manage and/or treat Rubella. As a non-limiting example, the AAV particles of the present invention comprise a nucleic acid sequence encoding at least one of the sequences described in Table 29 (SEQ ID NO: 6892-6895).

Human Papilloma Virus

Human papilloma virus (HPV) is a non-enveloped double-stranded DNA virus belonging to the family of Papillomaviridae. Over 170 types of HPV have been identified.

HPV infections may be asymptomatic, or cause infection related to warts (e.g. plantar, flat or anogenital warts), oral infections such as papillomas or multifocal epithelial hyperplasia. The infection may be undetected, and clears from the body to low levels within two years. Infections caused by human papillomavirus (HPV) have been associated with certain cancers of stratified epithelial tissues, e.g. cervical, anal, vaginal, vulvar and penile cancers, lung and throat cancers. Especially HPV 16 and HPV 18 are known to be carcinogenic. According to the WHO, persistent genital HPV infection may cause cervical cancer which is the second most common cancer in women worldwide. In developing countries, cervical cancer counts for 13% of all female cancers, and survivor rate worldwide is approximately 50%. HPV is very common. CDC estimates that every one in four individuals in the US has an HPV infection Most commonly HPV is transmitted by the sexual route, but also the vertical transmission route, or by direct contact to infected blood, or objects may occur.

Cancers caused by HPV may be prevented by vaccines developed against certain HPV types. The vaccines are available worldwide and are recommended by CDC for all preteen aged children. As of today, there are no specific treatment for HPV infection. There remains a need for prevention and treatment therapy affecting a broad range of HPV infections Antibodies for HPV have been developed, e.g. as described in International publication WO2015096269, the contents of each of which are herein incorporated by reference in their entirety.

In some embodiment, methods of the present invention may be used to prevent, manage and/or treat infections and complications caused by HPV AAV particles and methods of using the AAV particles described in the present invention may be used to prevent, manage and/or treat HPV. As a non-limiting example, the AAV particles of the present invention comprise a nucleic acid sequence encoding at least one of the sequences described in Table 30 (SEQ ID NO: 6896 and 6897).

Pseudomonas aeruginosa

Pseudomonas Aeruginosa (P. aeruginosa) is a common Gram-negative, aerobic, rod-shaped bacterium belonging to the family of Pseudomonodaceae. P. aeruginosa is found in soil, water, skin, flora, and in most man-made environments around the world P. aeruginosa is considered as an opportunistic pathogen taking advantage of a weakened immune system.

P. aeruginosa may cause a variety of mild infections, such as, urinary tract infections, respiratory, system infections, dermatitis, soft tissue infections, bacteremia, bone and joint infections, gastrointestinal infections, blood infections, ear infections, skin rash, eye infections and a variety of systemic infections. P. aeruginosa is transmitted through water, contaminated hands, materials or objects. In general, P. aeruginosa infections in healthy individuals are very mild or asymptomatic. However, the infections expose a significant risk for individuals with weakened immunity, such as patients with other underlying illnesses or complications, and especially when in a hospital environment. For example, patients with cystic fibrosis have a susceptibility towards loss of lung function due to respiratory tract infection with the bacterium. Patients attached to breathing machines, patients with catheters, or with surgery wounds or burn wounds are potentially at risk for serious and life-threatening infections. P. Aeruginosa infection may lead to a fatal sepsis. According to CDC, approximately 51,000 healthcare associated infection occur in the US every year, leading to approximately 400 deaths.

As of today, there are no prevention therapies for P. aeruginosa infection on the market. Some strains of P. aeruginosa may be treated with antibiotics, e.g. gentamicin, tobramycin, colistin, and amikacin. However, an increasing number of strains of P. aeruginosa, especially those affecting hospitalized patients, are resistant to antibiotics and no specific treatment therapy exists. There remains a need for improved treatment and prevention therapies against P. aeruginosa infections. Antibodies against P. aeruginosa have been developed, such as, panobacumab (developed by Kenta Biotech Inc.), which is an antibacterial antibody against *P. aeruginosa*.

In some embodiment, methods of the present invention may be used to prevent, manage and/or treat infections and complications caused by *P. aeruginosa*.

AAV particles and methods of using the AAV particles described in the present invention may be used to prevent, manage and/or treat *P. aeruginosa*. As a non-limiting example, the AAV particles of the present invention comprise a nucleic acid sequence encoding at least one of the sequences described in Table 32 (SEQ ID NO: 6912-7196).

*Streptococcus* Bacteria

*Streptococcus* is a genus of gram-positive bacteria belonging to the family of Streptoccaceae. Species of *Streptococcus* are divided into alpha- and beta-hemolytic species Alpha-hemolytic species cause oxidation of iron in hemoglobin molecules within the red blood cells. Alpha-hemolytic streptococci include e.g. *Streptococcus pneumoniae* and *Streptococcus virilans*. Beta-hemolytic species cause complete rupture of the red blood cells and include e.g Lancefield groups A and B, also known as 'group A strep' and 'group B strep'. *Streptococcus* genus includes overall more than 50 species. *Streptococcus* bacteria cause a variety of infections in humans, including dental caries, pneumonia, endocarditis, meningitis, respiratory tract infections, urinary tract infections, neonatal meningitis, pharyngitis and/or sepsis.

*Streptococcus pneumoniae* is a common bacterium causing, i.e. pneumonia, meningitis, bronchitis, acute sinusitis, conjunctivitis, osteomyelitis, endocarditis and/or septic arthritis. The bacteria is transmitted by direct contact or via the respiratory route. The bacteria resides in the nasopharynx of healthy carriers and proceeds into an infection under certain circumstances. The infection may be prevented by vaccines, e.g. conjugate vaccine or polysaccharide vaccines. The infection may be treated with antibiotics, e.g. broad-spectrum cephalosporin, and vancomycin, but there is a concern over increasing resistant towards antibodies. According to CDC, *Streptococcus pneumoniae* is currently resistant to one or more antibiotics in 30% of infections. *Streptococcus pneumoniae* is resistant to e.g. penicillins. There remains a need for improved, non-antibiotic, therapies for treatment of *Streptococcus pneumoniae* and other *Streptococcus* infections Antibodies for *Streptococcus* have been developed, as described e.g. in U.S. Pat. No. 5,686,070 and US Patent publication US20070003561, the contents of each of which are herein incorporated by reference in their entirety.

In some embodiment, methods of the present invention may be used to prevent, manage and/or treat infections and complications caused by *Streptococcus pneumoniae* and other *Streptococcus* bacteria.

AAV particles and methods of using the AAV particles described in the present invention may be used to prevent, manage and/or treat *Streptococcus pneumoniae*. As a non-limiting example, the AAV particles of the present invention comprise a nucleic acid sequence encoding at least one of the sequences described in Table 33 (SEQ ID NO: 6900-6902, 6905-6907, 6911, 7197-7229).

*Staphylococcus* Bacteria

*Staphylococcus* is a genus of gram-positive bacteria belonging to the family of Staphylococcacea. The genus includes overall approximately 40 species. Most species of the genus are harmless and reside in the skin and mucous membranes of humans. *Staphylococcus* bacteria may also be found in the soil. The bacteria may cause diseases either through toxin production or penetration. Staphylococcal toxins are a common cause of food poisoning. *Staphylococcus* bacteria may cause a variety of diseases, e.g. localized or diffuse skin infection, gastroenteritis, ear infections, septic arthritis, osteomrnyelitis, sinusitis, infective endocarditis and/or toxic shock syndrome.

*Staphylococcus aureus* (*S. aureus*) is typically residing in human nose asymptotically. In certain circumstances. *S. aureus* infections may affect many tissues and organs. Individuals with chronic conditions, e.g. diabetes, cancer, vascular disease, eczema and lung disease, have an increased susceptibility towards *S. aureus* infections. *S. aureus* may cause skin infections, such as, pimples, impetigo, atopic dermatitis, cellulitis folliculitis. More serious forms of infections include pneumonia, meningitis, osteomyelitis and endocarditis. *S. aureus* may also cause food poisoning. In severe cases, *S. aureus* infection may enter the blood stream causing bacteremia and/or sepsis. As of today, there is no medical therapy for prevention of the infection Some strains of *S. aureus* may be treated with antibiotics. However, increasing resistance towards antibiotics is a concern. Currently several antibiotic resistant forms of *S aureus* exist, including, but not limited to, Methicillin-resistant *Staphylococcus aureus* (MRSA). Vanconmycin-intermediate *Staphylococcus aureus* (VISA) and Vancomycin-resistant *Staphylococcus aureus* (VRSA) The drug resistant forms of *S. aureus* are more frequent in hospital environments.

*Staphylococcus epidermidis* (*S. epidermidis*) resides in the normal human skin flora and may cause an infection to individuals with weakened immune system, and to individuals who have catheters, prostheses or surgical implants. *S. epidermidis* has an ability to colonize on plastic materials or devices placed within the body. The infection may be treated with some antibiotics, but they do not remove the infection and can only be used to manage such infections. Many *S. epidermis* strains are resistant to antibiotics, such as penicillin, methicillin and/or amoxicillin, and increasing resistance to antibiotics in a concern.

There remains a need for prevention and/or improved treatment therapies against Staphylococcal infections. Antibodies targeting Staphylococcal bacteria have been developed. As an example, pagadaximab (developed by Medimnunune and AstraZeneca) is a monoclonal antibody for prevention of staphylococcal sepsis and may be administered to infants with low birth weight.

In some embodiment, methods of the present invention may be used to prevent, manage and/or treat infections and complications caused by *Staphylococcus* bacteria.

AAV particles and methods of using the AAV particles described in the present invention may be used to prevent, manage and/or treat Staphylococcal infections. As a non-limiting example, the AAV particles of the present invention comprise a nucleic acid sequence encoding at least one of the sequences described in Table 34 (SEQ ID NO: 7230-7478).

*Clostridium tetani*

*Clostridium tetani* (*C. tetani*) is a rod-shaped, anaerobic, Gram-positive bacteria belonging to the family of Clostridiaccae. A matured bacterium develops a terminal spore, which is resistant to heat and common antiseptics. *C. tetani* produces tetanospasmin toxin. *C. tetani* is found as spores in soil and in the gastrointestinal tract of animals.

*C. tetani* infection spreads the tetanospamin toxin to the body, causing tetanus, also known as lock jaw. Tetanus is a dangerous disease characterized by painful tightening of the muscles. The disease may lead to locking of the jaw and neck, leading to inability to open mouth or swallow. The tightening may affect the whole body. In severe cases, the infection may lead to breathing difficulties, pneumonia, or pulmonary embolism. Even more serious is an infection acquired during pregnancy, leading to almost always fatal neonatal tetanus of an infant. The bacteria is typically transmitted through broken skin by direct contact with contaminated soil or objects, or saliva or feces of a contaminated animal. Especially susceptible are individuals with burns, puncture wounds, crush injuries or injuries with dead tissue, individuals having animal bites or scratches. Tetanus is fairly uncommon in developed countries. However, the WHO reported an estimated 50, 000 neonatal tetanus deaths in year 2008. A program form elimination of tetanus was started in 1989 by the WHO.

Tetanus may be prevented efficiently by a four vaccine combination, DTaP, Tdap, DT, and Td, given to children and adults. For adequate immunity, the primary vaccine is adrministered during childhood, a booster dose during adolescence and every 10 years thereafter during adulthood *C. tetani* infection may be treated with antibiotics, wound care and with human tetanus immune globulin (an antitoxin) Despite the existing treatment methods, approximately 10% of tetanus infections lead to death, according to CDC, There remains a need for longer lasting vaccine as well as improved treatment therapies against *C. tetani* infections. Antibodies against *C. tetani* have been developed, as described e.g. by Larrick. J. W. et al., 1992, *Immunol Rev.* 130, 69-85, and de Krulf. J. et al., 2009, *J. Mol Biol.* 387 (3), 548-558, the contents of each of which are herein incorporated by reference in their entirety.

In some embodiment, methods of the present invention may be used to prevent, manage and/or treat infections and complications caused by *C. tetani.*

AAV particles and methods of using the AAV particles described in the present invention may be used to prevent, manage and/or treat *C. tetani*. As a non-limiting example, the AAV particles of the present invention comprise a nucleic acid sequence encoding at least one of the sequences described in Table 35 (SEQ ID NO: 7479-7535).

*Bordetella*

*Bordetella* is a genus of Gram-negative, coccobacilli belonging to the family of Alcaliigenaceac. The structure of the bacteria consists of an outer membrane with lipopolysaccharides and phospholipids forming a capsule *Bordetelia* bacteria affecting humans include, but are not limited to, *B. pertussis, B. parapertussis* and *B. bronchiseptica, B. pertussis* resides in the upper air pathways, mostly the trachea and the bronchii, of humans. *B. parapertussis* resides in the upper air pathways of mammals. The bacteria release toxins that cause damage and swelling of the respiratory pathways.

Pertussis, also known as whooping cough, is a highly contagious infection of the respiratory track caused most commonly by *B. pertussis*, and occasionally by *B. parapertussis*. Typical symptoms of the infection include severe coughing and difficulty to breathe accompanied by a runny nose, apnea and fever. Additional complications for infants include pneumonia, convulsions, apnea, and encephalopathy. The bacteria are transmitted through the respiratory tract route. The disease is especially dangerous for infants According to CDC, about 30,0K00 infections were reported in the US in 2014. CDC reports 277 deaths occurring from 2000 through 2014, out of which 241 where infants less than 3 months of age.

Pertussis may be treated with antibiotics, such as, erythromycin, clarithromycin or azithromycin. However, an increasing resistance to antibiotics is a concern. Pertussis caused *B. pertussis* may be prevented by vaccination, e.g. by DTaP combination vaccine, which is recommended routinely for infants by CDC and WHO. Despite the widespread vaccination, the disease has insisted. The protection provided by the traditional vaccination is estimated to be 3-6 years. There remains a need for prevention therapies providing a longer lasting immunity, as well as for improved, non-antibiotic, treatments. Antibodies for prevention and/or treatment of pertussis have been developed, as described e.g. in International publication WO2014160098, and Hussein, A. H et al, 2007, *Infect. Immun.* 75 (11), 5476-5482, the contents of each of which are herein incorporated by reference in their entirety.

In some embodiment, methods of the present invention may be used to prevent, manage and/or treat infections and complications caused by *B. pertussis, B. parapertussis* and/or other *Bordetella* bacteria.

AAV particles and methods of using the AAV particles described in the present invention may be used to prevent, manage and/or treat *Bordetella* infection. As a non-limiting example, the AAV particles of the present invention comprise a nucleic acid sequence encoding at least one of the sequences described in Table 36 (SEQ ID NO: 7536-7560).

*Mycobacterium*

*Mycobacterium* is a genus of nonmotile and aerobic bacteria, belonging to its own family of Myobacteriaceae. Mycobacteria have an outer membrane, and a hydrophobic and waxy cell wall with mycolic acid/mycolates. The cell wall is neither truly Gram-positive nor—negative. In general, the infections are difficult to treat and the bacteria is naturally resistant to many antibiotics, e.g. penicillin, due to the cell wall. Mycobacteria includes species, such as, but not limited to, *M. tuberculosis*, Nontuberculous mycobacteria (NTM), *M. leprae, M. bovis, M. africanum*, and *M. micron.*

*M. tuberculosis* is a genetically diverse bacterium and most common and dangerous of the mycobacteria family species. *M. tuberculosis* causes tuberculosis (TB) which is an infection mainly affecting the lungs. Typical early symptoms include cough, fever, night sweat, and weight loss. The disease may be mild for a period of time and therefore early diagnosis is difficult. Eventually the symptoms get more severe and coughing sputum and blood may occur. TB may be transmitted by the respiratory tract. TB affects all ages of the population, but is most dangerous to children, and individuals with weakened immune systems, e.g. HIV patients. According to the WHO, TB is referred to as a top infectious disease killer worldwide. WHO reports an estimated 9.6 million infections of TB in 2014, out of which 1.5 million cases were fatal. The disease is globally spread, but it is most abundant in the South-East Asia and Western Pacific Regions.

TB may be prevented by vaccinations, i.e. Bacille Clamette-Guerin vaccine. The vaccine is provided for children and adults exposed to environments with high risk of infection. However, the vaccine is not always efficient against TB, e.g. due to the diversity of strains geographically. TB may be treated with a 6 to 9 month course of combinational antimicrobial drug therapy Antimicrobial drugs effective against TB include e.g. isoniazid, rifampin, ethambutol, and pyrazinamide. However, an increasing resistance towards the medication is a concern. Certain strains of existing TB are identified as multi-drug resistant TB strains, which do not respond to therapy with e.g. isoniazid, rifampicin, or other common drugs. WHO reports an estimated 480 000 multidrug-resistant TB infections in 2014. There remains a need for prevention therapies protecting against broad spectrum of strains, as well as for improved treatment of *M. tuberculosis* and/or other mycobacteria. Antibodies against mycobacteria have been developed, as described e.g. in US Patent publications US20130309237, US20130309237, US20600229438, the contents of each of which are herein incorporated by reference in their entirety.

In some embodiment, methods of the present invention may be used to prevent, manage and/or treat infections and complications caused by *M. tuberculosis* and/or other mycobacteria.

AAV particles and methods of using the AAV particles described in the present invention may be used to prevent, manage and/or treat mycobacterium related diseases. As a non-limiting example, the AAV particles of the present invention comprise a nucleic acid sequence encoding at least one of the sequences described in Table 37 (SEQ ID NO: 7561-7576).

*Francisella Tularensis*

*Francisella tularensis* (*F. tuliarensis*) is a facultative intracellular Gram-negative, rod-shaped bacterium belonging to the family of Francisellaceae. *F. tularensis* resides in invertebrates, birds, reptiles, fish, and mammals, including humans. It is one of the most infectious and pathogenic bacteria known (see, e.g. Pechous et al., 2009, *Microbiol Mol Biol Rev.*; 73(4): 684-711).

*F. yularensis* causes infection called Tularemia. Severity of tularemia varies from mild to fatal. *F. Tularensis* may be transmitted to a human by direct skin or eye contact, by the respiratory route or by consumption of contaminated food or drink. Most commonly, the infection is acquired while handling infected animals Most common form of tularemia is ulceroglandular tularemia, characterized by skin ulcers on the site of infection accompanied by swelling or regional lymph glands. Ulceroglandular tularemia is typically acquire by a tick, or deer fly bite. Pneumonic tularemia is an infection of the respiratory tract characterized by a cough, chest pain, and difficulty of breathing. Pneumonic tularemia is transmitted through the respiratory route and may be fatal if not treated. Oropharyngeal tularemia is transmitted by contaminated food or beverage and causes a sore throat, mouth ulcers, tonsillitis and swelling of lymph glands in the neck. Other forms of tularemia include glandular, oculoglandular (affecting the eyes) and typhoidal (combination of the general symptoms). *F. tularensis* is considered to be a potential biological and chemical warfare agent.

As of today, there is not preventive therapy for tularemia infection on the market. Some vaccines have been under development (see, e.g. Pechous et al., Microbiol Mol Biol Rev. 2009 December; 73(4): 684-711). Tularemia may be treated with antibiotics, such as, streptomycin, gentamicin, doxycycline, and ciprofloxacin. However, increasing resistance against antibiotics is a concern There remains a need for improved prevention and treatment therapies for *F. tularensis* infections. Antibodies against *F. tularensis* have been developed, e.g. as described by Rynkiewicz, M. J. et al., 2012, *Biochemistry*, 51 (28), 5684-5694 and Lu. Z., et al., 2013. *Immunology*, 140 (3), 374-389, the contents of each of which are herein incorporated by reference in their entirety.

In some embodiment, methods of the present invention may be used to prevent, manage and/or treat infections and complications caused by *F. tularensis*.

AAV particles and methods of using the AAV particles described in the present invention may be used to prevent, manage and/or treat *F. tularensis* related infections. As a non-limiting example, the AAV particles of the present invention comprise a nucleic acid sequence encoding at least one of the sequences described in Table 38 (SEQ ID NO: 7577-7592).

*Toxoplasma gondii*

*Toxoplasma gondii* is a parasitic protozoan infecting warm-blooded animals, including humans. Domestic cats and other felines are the most desired hosts for *Toxoplasma gondii*, as they are the only hosts where the protozoan is capable of sexual reproduction. According to CDC, more than 60 million people in the US may be infected by *Toxoplasma gondii*.

*Toxoplasma gondii* causes toxoplasmosis, which is typically asymptomatic in healthy individuals and is controlled by the natural immune system. The infection may be obtained from undercooked, contaminated food, especially pork, lamb and venison, from food contaminated by utensils, or contaminated hands, occasionally from contaminated drinking water, or by the fecal-to-oral route from cat feces. *Toxoplasma gondii* may also be transmitted by vertical route, especially when the protozoan is acquired during pregnancy. Children infected during or just prior to pregnancy may have eye problems, or brain damage at birth, or may develop symptoms later in their lives. Toxoplasmosis may be dangerous to individuals with a weakened immune system, such as patients with AIDS, undergoing certain chemotherapies or having organ transplants.

Toxoplasmosis may be treated with certain medications such as antibiotics called sulfadiazine and pyrimethamine, which is an anti-parasite medication used for e.g. malaria. However, resistance to both of the medications is an increasing concern. There remains a need for improved treatment methods as well as prevention therapies against *Toxoplasma gondii* infection. Antibodies targeting *Toxoplasma gondii* have been developed, as described by e.g. Graille, M. et al., 2005, *J. Mol. Biol.* 354 (2), 447-458, the contents of which are herein incorporated by reference in their entirety.

In some embodiment, methods of the present invention may be used to prevent, manage and/or treat infections and complications caused by *Toxoplasma gondii*.

AAV particles and methods of using the AAV particles described in the present invention may be used to prevent, manage and/or treat *Toxoplasma gondii* related infections. As a non-limiting example, the AAV particles of the present invention comprise a nucleic acid sequence encoding at least one of the sequences described in Table 40 (SEQ ID NO: 7617 and 7618).

*Candida* Yeast

Typically, species of yeast are commensals and endosymbionts of human hosts, but may cause an infection under certain circumstances. *C. albicans* is a yeast belonging to the family of Saccharomycetaceae *C. albicans* causes infection of the mouth characterized by white patches on the tongue, mouth and throat. The infection of the mouth is most typical with new born babies, the elderly and individuals with weakened immune system, e.g. HIV/AIDS patients. Optionally, the infection may affect the nails, leading o brittle and defected nails. Optionally, the infection may cause an infection of the vagina, leading to genital burning or uncomfortable discharge. Typically, *Candida albicans* infections are mild and localized. However, the infection may be severe or fatal for individuals with underlying health problems and left untreated. Invasive candidiasis refers to an infection spreading to many parts of the body, including the heart, brain, eyes, bones and/or joints. Candidemia refers to an infection where candida yeast is present in the blood stream. Severe forms of *C. albicans* infections affect individuals in health care environments, e.g. patients with central venous catheter, patients treated at an intensive care unit, patients undergoing antibiotic treatments, treatments for kidney failure, recovering from a surgery, and patients with chronic diseases, e.g. diabetes and/or HIV/AIDS. *C. albicans* is typically transmitted from mother to an infant during childbirth and it remains as a species of human's normal microflora. It may also be transmitted through the sexual transmission route. Other species of candida yeast family include, e.g., *C. glabrata*, *C. parapsilosis*, *C. tropicalis*, *C. krusei* and *C. lusitaniae*.

*C. albicans* infection may be treated with antifungal drugs, e.g. nystatin, clotrimazole, amphotericin B oral suspension) or systemic oral azoles (e.g. fluconazole, itraconazole, or posaconazole). Despite the medical therapy available, some forms of *C. albicans* infections are dangerous, or life-threatening. There remains a need for improved prevention, and/or treatment therapies against *C. albicans* infections, for example by antibody therapies. Efungumab (developed by NeuTec Pharma) is an antibody for treatment of invasive *C. albicans* infection.

In some embodiment, methods of the present invention may be used to prevent and/or treat *C. albicans* infections.

AAV particles and methods of using the AAV particles described in the present invention may be used to prevent, manage and/or treat *C. albicans* related infections. As a non-limiting example, the AAV particles of the present invention comprise a nucleic acid sequence encoding at least one of the sequences described in Table 41 (SEQ ID NO: 7619).

Human Immunodeficiency Virus (HIV)

Human immunodeficiency virus (HIV) is a roughly spherical enveloped RNA virus belonging to the family of Retroviridae. HIV is composed of two positive single-stranded RNA copies. The viral core contains a viral capsule protein, p24, which surrounds the two single stranded RNAs and the enzymes for HIV replication. The viral envelope consists of two lipid layers, the outer layer glycoprotein 120 (gp 120) and the transmembrane glycoprotein 41 (gp41). Gp 120 attached to the host cell whereas gp41 has a role in the cell fusion process. For replication, the virus needs a host cell and the RNA first transcribes into DNA by enzyme reverse transcriptase. HIV infects the CD4 lymphocyte (T cell) leading to depletion of CD4+ T cells and loss of CD4+ T-cell function, as infected cells loses its function and converts to a HIV-replicating cell. (see, e.g. Okoye and Picker, 2013, Immunol Rev.; 254(1): 54-64, and references therein) Additionally, HIV infection leads to B lymphocyte (B cell) hyper-activation and dysfunction (see, e.g. Moir and Fauci, 2009, Nat Rev Immunol.; 9(4): 235-245, and references therein). The virus may be transmitted through sexual transmission route, vertical transmission route, iatrogenic (medical procedure) route, or in direct contact with certain body fluids with high concentration of HIV, including e.g. blood, breast milk, semen, vaginal, and rectal secretions. Two types of HIV (HIV-1 and HIV-2) have been identified. HIV-1 has higher infectivity and has spread around the globe whereas HIV-2 is more localized to West Africa According to CDC, there is about 36.9 million people in the world with HIV/AIDS with about 2 million cases arising every year. The infection is most abundant in Sub-Saharan Africa.

In acute HIV infection stage, within 2-4 weeks after infection, infected patients experience flu-like illness. In the second stage the infection is asymptomatic and the HIV replication is at low level. The second stage may last for years or decades, especially when treated with HIV medication. Eventually, HIV causes acquired immune deficiency syndrome (AIDS), which is a clinical condition characterized by severe immunosuppression attacking the CD4 cells, making individuals susceptible to life-threatening malignancies and infections. Complications associated with HIV/AIDS include common bacterial and viral infections, parasite infections, certain cancers (e.g. Kaposi's sarcoma, Non-Hodgkin's lymphoma, and angiosarcoma), progressive multifocal leukoencephalopathy (PML) and wasting.

As of today, there is no prevention therapy or cure for HIV/AIDS. However, with antiretroviral (ART) therapy, the disease may be managed for a long period of time. ART therapy comprises of five classes of drugs used in different combinations to treat HIV. The drugs target the different phases of the retrovirus life-cycle. However, there remains a need for improved therapies for prevention, management and/or treatment of HIV/AIDS.

Antibodies for treatment and prevention of HIV infection have been developed. For example, commercial antibody Ibalizumab (developed by Taimed Biologics Inc.) is a non-immunosuppressive monoclonal antibody binding to CD4, *Anaplasma phagocytophilium* inhibiting the viral entry process. As another example, suvizumab (developed by Kaktsuden, Chemo-Sero Therapeutic Research Institute) is a humanized antibody targeting the HIV-1 envelope glycoprotein GP120. As a non-limiting example, any of the antibodies in Table 42, variants or fragments thereof may be used in the treatment and/or prevention of HIV.

Antibodies neutralizing HIV-1 and HIV-1 strains have been identified, but as of today, the researchers have not been able to develop a vaccination for HIV. HIV has a capability to evolve with unusually high somatic mutation and recombination rate. So far, conventional vaccines have not succeeded in eliciting analogues of the broadly neutralizing antibodies. An alternative approach suggested involves using adeno-associated vectored gene delivery for expression of antibodies from muscle tissue (e.g. Balasz et al, 2012. Nature Letter, 481, 81-84, Balasz et al. 2014, Nat Med.; 20(3): 296-300, Saunders et al., 2015, J Virol.; 89(16): 8334-45, and US Patent publication US20030219733, the contents of which are herein incorporated by reference in their entirety). The studies have demonstrated efficient and long lasting protection from HIV infection by e.g. intravenous or mucosal surface transmission.

AAV Particles and methods of using the AAV particles described in the present invention may be used to prevent, manage and/or treat I-IV infection and AIDS. As a non-limiting example, the AAV particles of the present invention comprise a nucleic acid sequence encoding at least one of the sequences described in Table 42 (SEQ ID NO: 7620-9220).

Therapeutic Applications: Toxins

AAV particles and methods of using the AAV particles described in the present invention may be used to prevent, manage and/or treat infectious disease. As a non-limiting example, the AAV particles of the present invention comprise a nucleic acid sequence encoding at least one of the sequences described in Tables 14-17 (SEQ ID NO: 3549-3914).

Toxins are a group of substances that are highly poisonous and dangerous to humans. Toxins are infectious agents in form of bacteria, viruses, fungi, proteins, and other chemical and/or biological substances. Toxins may lead to fatal conditions Toxins are produced by nature, and may be produced synthetically. Exposure to toxins may be unintentional and occur when in contact with toxic plants, or contaminated food, water, livestock or animals. Due to the life-threatening impact of toxins, they are considered to be potential biological and/or chemical warfare agents that may be applied as weapons of mass destruction in war field. They also impose a threat to be used as means for terrorist attacks.

Ricin

Is a naturally occurring carbohydrate-binding lectin protein produced by castor oil plant growing in Eastern Africa, India, Southeastern Mediterranean basin area, and in tropical regions. Ricin may also be manufactured from the waste products when processing castor beans. Ricin has a globular structure with two toxin chains, chain A and chain B, which both need to be present for the cytotoxic affect. Ricin kills cells by inhibiting protein synthesis. Chain B penetrates to the cell whereas the disulfide bond joining chain A to chain B lectin has an affinity to bind to cell surface carbohydrates, (see, e.g. Friedman and Rasooly, 2013, *Toxins* (Basel); 5(4): 743-775). Ricin is highly toxic to humans with median lethal dose ($LD_{50}$) of 22 micrograms per kilogram of body weight. The exposure to Racin may be by inhaling, ingestion or by injection. The symptoms are dependent of the method of exposure. When inhaled, ricing causes severe inflammation of the lungs, causing would has symptoms including coughing, difficulty breathing, muscle ache and nausea. When ingested, ricin induces internal bleeding of the stomach and intestines leading to pain, vomiting and bloody diarrhea, and eventual failure of the kidneys, liver and spleen. When injected, ricin induces failure of the muscles and lymph nodes, and eventually failure of the liver, kidney and spleen. There is no known treatment for Ricin poisoning.

Unintentional poisoning by Ricin is uncommon. However, Ricin is a potential biological and chemical warfare agent creating a need for treatment and prevention therapies for ricin poisoning. Antibodies targeting ricin have been developed, as described e.g. in International publication WO2015100409, the contents of which are herein incorporated by reference in their entirety.

In some embodiment, methods of the present invention may be used to prevent, manage and/or treat infections and complications caused by ricin.

AAV particles and methods of using the AAV particles described in the present invention may be used to prevent, manage and/or treat Ricin related infections and/or conditions. As a non-limiting example, the AAV particles of the present invention comprise a nucleic acid sequence encoding at least one of the sequences described in Table 14 (SEQ ID NO: 3549-3568).

*Bacillus anthracis*

*Bacillus anthracis* is a Gram-positive, rod-shaped bacterium causing anthrax disease (see, e.g. Spencer, 2003, *J Clin Pathol.*; 56(3): 182-187, and references therein). Most animals, especially herbivores, are susceptible to infection of *Bacillus anthracis*. Anthrax may be infected via respiratory exposure, skin contact or eating contaminated food, in most cases meat. Inhaled anthrax causes flu-like symptoms, pneumonia and severe respiratory collapse. Gastrointestinal anthrax causes severe diarrhea, acute inflammation of the intestinal tract, and vomiting of blood. Skin exposure to the bacteria will lead to boil-like skin lesions forming an ulcer with black center. Typically, infection to humans occurs by eating contaminated meat or while handling infected animals or their product, such as skin, wool or meat. *Bacillus anthracis* is a potential biological warfare agent. In 2001, weeks following the September 11 terrorist attacks, letters containing *Bacillus anthracis* were mailed to news media offices and two U.S. Senators resulting in death of five people and infected many more.

Anthrax may be treated with antibiotics, such as penicillin and amoxicillin, and may be prevented by vaccines, developed both for humans and animals. However, due to increased threat of biological warfare and terrorism, improved methods of treatment are in demand. Anthrax may also be treated by antibody therapy. For example. Raxibacumab (developed by Cambridge Antibody Technology and Human Genome Sciences) is an antibody for the prophylaxis and treatment of inhaled anthrax.

In some embodiment, methods of the present invention may be used to prevent, manage and/or treat infections and complications caused by *Bacillus anthracis*.

AAV particles and methods of using the AAV particles described in the present invention may be used to prevent, manage and/or treat *Bacillus anthracis* related infections and/or conditions. As a non-limiting example, the AAV particles of the present invention comprise a nucleic acid sequence encoding at least one of the sequences described in Table 15 (SEQ ID NO: 3569-3813).

Shiga Toxin and Shiga-Like Toxin

Shiga toxin, including two major types Stx1 and Stx2, is a toxin produced by *Shigella dysenteriae*, a rod-shaped bacteria belonging to bacterial genus *Shigella*. Shiga toxin inhibits protein synthesis within cells. The toxin enters cell via a marcopinosome and inhibits the protein synthesis by cleaving a specific nucleobase RNA of the 60S subunit of ribosome. Shiga-like toxins 1 and 2 are structurally similar to Stx1 and Stx2 and are produced by enterohemorrhagic strains of *Escherichia coli* (EHEC) strains. (see, e.g. Friedman and Rasooly, Toxins (Basel). 2013 April; 5(4): 743-775) EHEC type 0157 is the most common pathogen causing *E. Coli* outbreaks in the US. Stx2 is considered to be orders of magnitude more toxic that Stx1. The severity of Shiga toxin foodborne illnesses range from mild diarrhea to a life-threatening complication known as hemolytic uremic syndrome (HUS). HUS is a disease associated with hemolytic anemia, acute kidney failure and low platelet count. Cattle is the major source or infection to humans, but the disease may be spread by birds or pigs. Shiga infection is typically obtained from contaminated food or drink, such as meat, unpasteurized milk, or contaminated water, or by contact with cattle Shiga toxin and Shiga-like toxins considered to be potential chemical and biological warfare agents.

As of today, there is no prevention therapy or specific treatment for Shiga and Shiga-like toxins. Recent developments have been made in antibody therapy of Shiga toxin induced HUS. For example, SHIGAMAB® (developed by Bellus Health Inc.) is a monoclonal antibody for treatment of Shiga toxin induced HUS.

In some embodiment, methods of the present invention may be used to prevent, manage and/or treat infections and complications caused by *Shigella dysenteriae*.

AAV particles and methods of using the AAV particles described in the present invention may be used to prevent, manage and/or treat *Shigella dysenteriae* related infections and/or conditions. As a non-limiting example, the AAV particles of the present invention comprise a nucleic acid sequence encoding at least one of the sequences described in Table 17 (SEQ ID NO: 3844-3914).

Botulinum Toxins

Botulinum toxins are neurotoxins produced by *Clostridium bacteria* and they cause a disease called botulism which is characterized by weakness, problems in vision, tiredness, and problems with speech, followed by weakness of the arms, chest muscles and legs. Botulism may be fatal. There are seven different botulinum neurotoxins with a four-domain structure varying in antigenic properties and interactions with intracellular targets. L-chain enters the cytosol, cleaves the synaptosomal protein and blocks neurotransmitter release resulting in peripheral neuromuscular blockade and flaccid paralysis in humans. (see, e.g. Friedman and Rasooly. Toxins (Basel) 2013 April; 5(4): 743-775) Botulinum neurotoxins are highly dangerous to humans, serotype A having a median lethal dose ($LD_{50}$) of 0.8 micrograms for a human of 70 kg weight. The bacteria is common in soil and water and may produce the botulinum toxins when exposed to low oxygen levels and certain temperatures. Outbreaks of foodborne botulism occur occasionally. Most susceptible to contamination by botulinum are baked products, fresh mussels, canned fruit and vegetables. Infant botulism occurs when the toxins are produced and released by bacteria in the infant's intestines. Botulism may also occur in wounds where the bacteria in the absence of oxygen produces and releases the toxins. Wound botulism is most common in cases where contaminated needles are used for injection. Botulinum toxins are potential biological and chemical warfare agents.

As of today, there is no prevention therapy for botulism. Botulism may be treated with antitoxins that block the circulation of toxins in the blood and prevent worsening of the disease. However, the antitoxins are expensive and not easily available. In cases of wound botulism, the area infected may be removed surgically. Additionally, good supportive care therapy is applied There remains a need for therapies to prevent and treat botulism. Antibodies targeting botulinum toxins are developed, as described e.g. in US Patent publication US20130058962, and International publication WO2015100409, the contents of each of which are herein incorporated by reference in their entirety.

In some embodiment, methods of the present invention may be used to prevent, manage and/or treat infections and complications caused by botulinum toxins.

AAV particles and methods of using the AAV particles described in the present invention may be used to prevent, manage and/or treat botulinum toxin related infections and/or conditions. As a non-limiting example, the AAV particles of the present invention comprise a nucleic acid sequence encoding at least one of the sequences described in Table 16 (SEQ ID NO: 3814-3843).

Therapeutic Applications: Neglected Tropical Diseases (NTDs)

AAV particles and methods of using the AAV particles described in the present invention may be used to prevent, manage and/or treat infectious disease. As a non-limiting example, the AAV particles of the present invention comprise a nucleic acid sequence encoding at least one of the sequences described in Tables 10-13 (SEQ ID NO: 3327-3548).

Neglected Tropical diseases (NTDs) are a diverse category of communicable diseases present in tropical and subtropical environments. NTDs affect more than one billion people in about 150 countries. NTDs are a significant public health problem costing the involved developing economies billions of dollars annually. The diseases affect mostly the populations with inadequate sanitation, and those in contact with infectious vectors, domestic animals and livestock. In May 2013, the $66^{th}$ WHO Assembly announced resolution WHA66.12 to integrate measures and plan investments to improve the wellbeing of populations affected by NTDs. NTDs include Buruli ulcer, Chagas disease, Dengue and Chikungunya, Dracunculiasis (guinea-worm disease). Echinococcosis, Endemic treponematoses (Yaws), Foodborne trematodiases, Human African trypanosomiasis (sleeping sickness), Leishmaniasis, Leprosy (Hansen disease), Lymphatic filariasis, Onchocerciasis (river blindness), Rabies, Schistosomiasis. Soil-transmitted helminthiases, Taeniasis/Cysticercosis and Trachoma.

Chikungunya Virus

Chikungunya virus is an arbovirus belonging to the Togoviridae family. The genome is a single-strand RNA molecule encoding four non-structural and three structural glycoproteins (C, E1, E2) (see, e.g. Caglioti et al., 2013, *New Microbiol.;* 36(3):211-27, and references therein). Chikungunya fever is a mosquito-borne disease caused by chikungunya virus. The symptoms include a fever lasting 2-7 days, rash and flu-like symptoms accompanied by a joint pain that may last for weeks, months or even years. The disease may be dangerous for the elderly and individuals with chronic medical problems. Chikungunya virus is spread by *Aedes albopictus* and *Aedes aegypti*. Outbreaks of chikungunya fever have occurred in Africa, Asia, Europe and Indian and Pacific Oceans, and more recently in islands in the Caribbean. As an example, according to the WHO, an outbreak of 1.9 million cases in India, Indonesia, Maldives, Myanmar and Thailand since 2005 has been reported. More recently, as of April 2015 more than million cases have reported in Caribbean Islands. Latin American countries and the United States.

As of today, there is no specific treatment or vaccination for chikungunya fever. The disease is typically treated with supportive care therapy, as well as anti-inflammatory drugs and medicines to relieve the symptoms. Research and development on vaccinations has been done but none has been approved for commercial use so far Antibodies for detection and treatment of Chikungunya have been developed. E.g. fully human antibodies binding to an epitope located in an antigenic site of the chikungunya virus E1 and E2 envelope proteins were in US Patent Publication US20130189279, the contents of each of which are incorporated herein by reference in their entirety.

In some embodiment, methods of the present invention may be used to prevent, manage and/or treat infections and complications caused by chikungunya virus.

AAV particles and methods of using the AAV particles described in the present invention may be used to prevent, manage and/or treat chikungunya virus related infections and/or conditions. As a non-limiting example, the AAV particles of the present invention comprise a nucleic acid sequence encoding at least one of the sequences described in Table 13 (SEQ ID NO: 3543-3548).

Dengue virus

Dengue virus belongs to the family of Flaviviridae, genus of Flavivirus. It is an enveloped, positive strand RNA virus containing two integral membrane proteins envelope (E) and premembrane (prM) Dengue virus is closely related to e.g. Yellow fever. West Nile virus and St. Louis and Japanese encephalitis viruses. There are five serotypes of the virus that can cause dengue fever, which is a mosquito-borne tropical disease. Neutralizing antibodies target the protein E as it binds to the cellular receptors and mediates the viral entry into cells Infection with a serotype may produce a lifelong immunity to that serotype but no long-term immunity against other serotypes, (see e.g., Wahala and de Silva, 2011, *Viruses.;* 3(12): 2374-2395, and references therein). In fact, an infection by a second serotype may lead to a more severe form of disease, due to the complexity of the antibody respond and possible antibody dependent enhancement (ADE), which hypothesizes that weakly neutralizing antibodies from the first infection bind to the second serotype and enhance the infection. The symptoms of dengue fever are similar to flu, including fever, headache, muscle and joint pain and skin rash. The disease may also manifest as a potentially lethal complication called severe dengue, also known as dengue hemorrhagic fever. The disease may be dangerous to individuals with chronic diseases, such as diabetes or asthma, or children and the elderly. Dengue virus is spread by several mosquito species, out of which *Aedes aegypti* is the most common. Dengue may also be transmitted via infected blood or organ donation or by the vertical transmission route. According to the WHO, the estimated number of dengue infections annually could be as high as 390 million.

As of today, there is no specific treatment or prevention therapy for dengue fever. Antibodies targeting dengue virus have been developed. As an example, antibodies neutralizing four serotypes of dengue virus have been in US Patent publication US20150225474. US20150218255 and in U.S. Pat. No. 9,073,981, the contents of each of which are incorporated herein by reference in their entirety.

In some embodiment, methods of the present invention may be used to prevent, manage and/or treat infections and complications caused by dengue virus.

AAV particles and methods of using the AAV particles described in the present invention may be used to prevent, manage and/or treat Dengue virus related infections and/or conditions. As a non-limiting example, the AAV particles of the present invention comprise a nucleic acid sequence encoding at least one of the sequences described in Table 10 (SEQ ID NO: 3327-3449).

*Trypanosoma cruzi*

*Trypanosoma cruzi* (*T. cruzi*) is a species of parasitic euglenoid protozoan. *T. cruzi* causes Chagas disease, also known as American trypanosomiasis, which is a tropical parasitic disease. The symptoms of Chagas disease at the early stage include fever, swollen lymph nodes, headaches or local swelling at the site of bite. The chronic phase of Chagas starts after 8-12 weeks, which may be symptomless, or include enlargement of the ventricles of the heart, which may result in heart failure, or to an enlarged esophagus or enlarged colon. The severity of Chagas disease varies from almost unnoticeable to fatal. Chagas disease is spread by an insect vector triatomine bug. These bugs get infected with *T. cruzi* by feeding on the blood of an infected human or animals, and they spread it further by bites and ingestion of blood. The triatomine bug is also known as a "kissing bug" referring to its tendency to feed on people's faces *T. cruzi* may also be transmitted through blood transfusions or through breast milk. Chagas disease is present mainly in 12 Latin American countries, but has also spread to other continents. According The WHO, over 10 000 people die every year from Chagas disease, and 25 million people are in the risk of infection.

As of today, there is no specific prevention or treatment therapy for Chagas disease. The traditional therapies for Chagas have been involved with attempts to kill the parasite and treatment of the symptoms. For example, azole and nitro-derivative drugs have been used, but have not been successful in removal of the parasite fully. Other mechanisms to treat the disease have been under research. After infection in mammals, the parasite incorporates a charged carbohydrate (sialic acid) to survive to the chronic phase of the disease. To do so, the parasite scavenged sialic acid it from the host's sialoglycococonjugates, through a transglycosylation reaction catalyzed by an enzyme called trans-sialidase. The trans-sialidase has been identified as a potential target for drug development Buschiazzo et al. have reported an antibody inhibiting the *T. cruzi* trans-sialidase enzyme providing an antibody therapy mechanism for Chagas disease (see, Buschiazzo et al., 2012, *PLoS Pathol.* 8 (1), E1002474, and references therein).

In some embodiment, methods of the present invention may be used to prevent, manage and/or treat infections and complications caused by Chagas disease.

AAV particles and methods of using the AAV particles described in the present invention may be used to prevent, manage and/or treat Chagas disease. As a non-limiting example, the AAV particles of the present invention comprise a nucleic acid sequence encoding at least one of the sequences described in Table 12 (SEQ ID NO: 3541 and 3542).

Rabies Virus

Lyssaviruses are a genus of RNA viruses belonging to the family of Rhabdoviridae. Rabies virus is a neurotropic virus with cylindrical morphology After infection, rabies virus enters the peripheral nervous system, and further to central nervous system by retrograde axonal transport Rabies virus and Australian bat lyssavirus cause rabies Rabies affects humans and warm-blooded animals. The early stage symptoms include flu-like signs, but later the disease manifests as paralysis, anxiety, insomnia, abnormal behavior, hallucinations. Humans and animals infected may also experience hydrophobia, "fear of water", which is considered a characteristic symptom of the disease Eventually the disease affects the central nervous system and brain, causing death. Humans are typically infected by being bitten, scratched or licked by an animal with the disease. Most commonly the infection is by dogs. Whereas efficient vaccination programs for animals have been able to reduce or even eliminate rabies in developing countries, the disease still affects poor population mainly in Africa and Asia. According to the WHO, post-bite treatment and vaccination is provided for 15 million people annually.

Rabies is a vaccine-preventable disease and especially systematic vaccination of dogs has been a cost-effective strategy for prevention of rabies. Post-exposure prophylaxis (PEP), the treatment of bite victims immediately after the exposure, includes local treatment of the wound, rabies vaccination and administration of rabies immunoglobulin. Though efficient vaccines for rabies have been developed, there remains a need for treatment/or management of rabies to prevent death after rabies virus has entered the central nervous system (see, e.g., Hicks et al., 2012, *Clin Exp Immunol.;* 169(3): 199-204, and references therein). The genome of rabies virus codes for five viral proteins. Out of the five. G protein, which is an external surface glycoprotein, forms protrusions that cover the outer surface of the virion envelope and is known to induce neutralizing antibodies. Also, nucleoprotein (N) molecules and the phosphoprotein (NS) participate in immune responses. G protein has been the target of antibody developments. For example, therapeutic antibodies against rabies virus are taught in U.S. Pat. Nos. 7,071,319, 6,890,532, and 9,005,624, the contents of each of which are incorporated herein by reference in their entirety.

In some embodiment, methods of the present invention may be used to prevent, manage and/or treat infections and complications caused by rabies virus.

AAV particles and methods of using the AAV particles described in the present invention may be used to prevent, manage and/or treat rabies virus related infections and/or conditions. As a non-limiting example, the AAV particles of the present invention comprise a nucleic acid sequence encoding at least one of the sequences described in Table 11 (SEQ ID NO: 3450-3540).

Therapeutic Applications: Tropical Diseases (TDs) and Vector-Borne Diseases

AAV particles and methods of using the AAV particles described in the present invention may be used to prevent, manage and/or treat infectious disease. As a non-limiting example, the AAV particles of the present invention comprise a nucleic acid sequence encoding at least one of the sequences described in Tables 10-13 (SEQ ID NO: 3327-3548).

*Plasmodium falciparum*

Plasmodium falciparum (*P. falciparum*) is a protozoan parasite belonging to *Plasmodium* parasite family. *P. falciparum* is the main cause of malaria and responsible for nearly all death cases in malaria. *P. falciparum* is released to the human bloodstream through mosquito saliva. The parasite has a high rate of replication and capability to alter. *P. falciparum*, among other *Plasmodium* parasites, cause malaria, which is a mosquito borne tropical disease. The early stage symptoms include fever, headache, chills and vomiting. If not treated at the early stage, malaria can progress to a life-threatening condition involving multiple organs, resulting in skin yellowing, seizures and coma. In children, malaria may cause severe anemia, respiratory distress in relation to metabolic acidosis, and/or cerebral malaria. The disease is especially dangerous for young children, pregnant women and individuals without immunity to the disease, such as travelers from non-malaria areas. An infection may develop a partial immunity, allowing the following infections to be asymptomatic According to the WHO, about half of world's population are at risk of malaria. Sub-Saharan Africa carries the highest density of malaria. In 2015, 88% of malaria cases and 90% of malaria deaths was in Sub-Saharan Africa Malaria is spread by female *Anopheles* mosquitos and caused by 5 different parasite species, out of which *Plasmodium falciparum* is the most prevalent and responsible for the severe cases of malaria.

Despite tremendous efforts, there is no commercial vaccination for malaria. Traditional treatment for malaria consists of antimalarial medicine therapies, such as artemisinin-based combination therapies, which consists of artemisinin combined with antimalarial drugs such as amodiaquine, lumefantrine, mefloquine and sulfadoxine/pyrimethamine. However, drug resistance has been a serious challenge in malaria treatment. Currently resistance is common for all antimalarial medications apart from artemisinin combination therapy. The cost of artemisinin treatment is high and there remains a need for prevention therapies and improved treatment against malaria.

Due to the polymorphic nature and high replication rate of *P. falciparum*, tolerance to malaria is achieved only after years of repeated infections Antibodies for prevention and treatment of malaria have been developed. For example, antibodies against *P. falciparum* are taught in U.S. Pat. No. 7,811,569, in US Patent publication US20150197562 and in International Patent publication WO2014087007, the contents of each of which are incorporated herein by reference in their entirety. A need for mechanism to deliver constant, effective concentration of malaria antibody for a long period is still in need Studies by Deal et al, demonstrate results on vectored immunoprophylaxis delivery of malaria antibodies to mice (see. Deal et al. PNAS, 2014, 111(34), 12528-12532).

In some embodiment, methods of the present invention may be used to prevent, manage and/or treat infections and complications caused by *P. falciparum*.

AAV particles and methods of using the AAV particles described in the present invention may be used to prevent, manage and/or treat *P. falciparum* related infections and/or conditions. As a non-limiting example, the AAV particles of the present invention comprise a nucleic acid sequence encoding at least one of the sequences described in Table 18 (SEQ ID NO: 3915-3971).

Ebola Virus

Genus of Ebola virus includes five viruses. Zaire, Reston, Sudan. Tai Forest and Bundibygvo Ebola viruses, is a negative-sense RNA virus belonging to the family of filoviridae. The West Africa outbreak has been associated with Zaire Ebola virus. The genome of Ebolavirus encodes seven genes. The glycoprotein GP gene encodes two distinct gene products: sGP which is a dimeric and secreted glycoprotein and less abundant GP, which is a trimeric-virion attached, membrane embedded envelope glycoprotein and responsible for the virus attachment, fusion and entry during infection. Ebola virus disease is a hemorrhagic fever disease caused. The early symptoms include fever, sore throat, muscular pain, followed by a diarrhea and rash. Eventually the disease will affect the liver and kidney function, and cause internal bleeding. The disease is highly fatal, as about 50% infected individuals die. The Ebola virus is transmitted by direct contact with the blood and body fluids and tissues of an infected person or an animal, most commonly a chimpanzee, gorilla, fruit bat, monkey, forest antelope and porcupine. The disease is also transmitted when handling dead bodies of infected animals or humans. Also, sexual transmittance of the disease has been suggested. The WHO has reported more than 28 000 infections and 11 000 deaths in Ebola virus disease outbreak in West Africa (2014-present), mainly affecting Guinea, Sierra Leone and Liberia.

As of today, there is no licensed treatment or prevention therapy proven to neutralize the virus. Typically. Ebola virus disease is treated with a good supportive care. A variety of blood, immunological and drug therapies are under investigation, as well as preventive vaccines undergoing evaluations. However, a demand for effective therapies for treatment and prevention of Ebola virus disease remain.

Viral surface of GP has been identified as a target for neutralizing antibodies. Antibodies targeting GP of Ebola virus have been taught, e.g. in International Patent publication WO2015127136 and Olal. D., et al., 2012. *J. Virol.* 86 (5), 2809-2816, the contents of each of which are incorporated herein by reference in their entirety.

In some embodiment, methods of the present invention may be used to prevent, manage and/or treat infections and complications caused by Ebola virus.

AAV particles and methods of using the AAV particles described in the present invention may be used to prevent, manage and/or treat Ebola related infections and/or conditions. As a non-limiting example, the AAV particles of the present invention comprise a nucleic acid sequence encoding at least one of the sequences described in Table 19 (SEQ ID NO: 3972-4024).

Marburg Virus

Marburg virus belongs to the filoviridae family of viruses with coiled, toroid or branched structures with seven proteins. The structure of Marburg virus is similar to Ebola virus, however, the involved antigens are different. The filoviruses express a single glycoprotein on their surface. The glycoprotein is responsible for the infection, as it is involved in the attachment and entry of the viruses causing infection. Marburg virus disease is a hemorrhaging fever disease caused by Marburg virus. It is highly fatal disease and related to Ebola virus diseases. The early symptoms of the disease include severe headache and malaise. Severe hemorrhagic manifestations in later stages include bleeding from multiple sites. The Marburg virus is transmitted by direct contact with the blood and body fluids and tissues of infected persons or animals, most commonly fruit bats and monkeys. The disease is also transmitted when handling dead the bodies of infected animals or humans. Marburg virus disease is uncommon, but outbreaks typically have a high rate of fatality. According to the WHO, the death rate was as high 80% in outbreaks of 1998-2000 in Democratic Republic of Congo and 2005 in Angola.

As of today, there is no preventive or treatment therapy for Marburg virus disease. The current treatment methods include good supportive treatment. The surface glycoprotein has been a target for development of antibodies for Marburg disease vaccines and treatments. For example, International Patent publication WO02015127140, and US Patent publication US20140356354, the contents of which are incorporated herein by reference in their entirety, teach therapeutic antibodies that recognize glycoprotein of filoviruses for different strains of Marburg, as well as Ebola.

In some embodiment, methods of the present invention may be used to prevent, manage and/or treat infections and complications caused by Marburg virus.

AAV particles and methods of using the AAV particles described in the present invention may be used to prevent, manage and/or treat Marburg related infections and/or conditions. As a non-limiting example, the AAV particles of the present invention comprise a nucleic acid sequence encoding at least one of the sequences described in Tables 3-42 (SEQ ID NO: 2948-9220).

West Nile Virus

West Nile virus (WNV) is a positive-stranded RNA of the flavivirus genome and member of the Japanese encephalitis serocomplex of flaviviruses. (see Throsby, M. J. Virol. 80 (14), 6982-6992 (2006)). Two lineages of the virus have been identified. The genome of the virus encodes a single polyprotein producing three structural proteins, capsid C, precursor membrane prM and envelope E as well as seven nonstructural proteins. WNV causes mosquito-borne infections with a variety of manifestations. Tough about 80% of WNV infections are symptomless and not harmful, in certain cases, the disease may lead to fatal neurological diseases. Infection of MNV may lead to a West Nile fever, which causes flu-like symptoms accompanied by high fever, headache, chills, excessive sweating, fatigue, weakness, swollen lymph nodes, and joint pains Infection by MNV may also occur as cutaneous manifestations, including rashes that may include punctate erythematous, macular and popular eruptions. West Nile infections may also affect the central nervous system resulting in West Nile neuroinvasive diseases, including meningitis, encephalitis, meningoencephalitis and poliomyelitis-like syndrome. These neuroinvasive forms of NWV infections occur in only about 1% of infections, but they may be life-threatening. WNV is commonly found in Africa. Europe, the Middle East. North America and West Asia. WNV is typically transmitted to humans and other mammals by mosquitos and is maintained in nature in a cycle involving transmission between birds and mosquitoes WNV is carried by different types of mosquitos, dependent on geographical distribution. Transmission to humans may also occur from birds, horses or other humans.

As of today, there is no specific treatment or prevention therapy for MNV infections. Current methods of treatment include good supportive care. Due to severity of some of the manifestations, there remains a need for such therapies.

Envelope E has been a target of most antibody related studies. Antibodies targeting M and the first non-structural protein have also been investigated. As an example. Thorsby et al, 2006, J. Virol. 80 (14), 6982-6992, the contents of which are incorporated herein by reference in their entirety, teaches antibodies binding to E and prM proteins. U.S. Pat. Nos. 8,663,950 and 7,527,973, the contents of each of which are incorporated herein by reference in their entirety, teach antibodies binding to E protein of WNV.

In some embodiment, methods of the present invention may be used to prevent, manage and/or treat infections and complications caused by West Nile virus.

AAV particles and methods of using the AAV particles described in the present invention may be used to prevent, manage and/or treat West Nile virus related infections and/or conditions. As a non-limiting example, the AAV particles of the present invention comprise a nucleic acid sequence encoding at least one of the sequences described in Table 20 (SEQ ID NO: 3333, 3359, 3393, 3418, 3442, 4025-4137).

Yellow Fever Virus

Yellow fever virus is an enveloped RNA virus belonging to the Flavivirus family Yellow fever, also known as Yellow Jack. Yellow Plague or Bronze John, is a mosquito-borne viral hemorrhagic disease. In most cases, the symptoms include fever, headache, chills, loss of appetite, nausea, and muscle pain. In some occasions, the disease progresses to a second stage which includes fever accompanied by abdominal pains, liver damage resulting in jaundice, kidney problems and/or bleeding. The disease is spread primarily by Aedes and Haemogogus type mosquitos. The disease is most typical in tropical environments. According to the WHO, there are 200 000 annual cases of yellow fever resulting in 30 000 deaths mainly in Africa and Latin America, 90% of cases occur in Africa.

Preventive live-attenuated vaccines for yellow fever are available. However, concern related to post-vaccine adverse events has decreased the popularity of the vaccines. The vaccination is not recommended to infants younger than 9 months, pregnant women and individuals with an immune deficiency. As of today, there is no specific treatment for yellow fever. Current methods for treatment involve with supportive care to treat dehydration, respiratory failure and fever There is a need for improved prevention and treatment therapies against yellow fever virus.

Envelope E glycoprotein of yellow fever virus has been identified as a potential target for antibody therapies. Neutralizing antibodies for yellow fever virus have been reported by Thibodeaux, B. A. et al, 2012, Antiviral Res. 94 (1), 1-8 and Daffis, S. et al., 2005, Virology, 337 (2), 262-272, the contents of each of which are incorporated herein by reference in their entirety.

In some embodiment, methods of the present invention may be used to prevent, manage and/or treat infections and complications caused by yellow fever virus.

AAV particles and methods of using the AAV particles described in the present invention may be used to prevent, manage and/or treat yellow fever virus related infections and/or conditions. As a non-limiting example, the AAV particles of the present invention comprise a nucleic acid sequence encoding at least one of the sequences described in Table 20 (SEQ ID NO: 3333, 3359, 3393, 3418, 3442, 4025-4137)

Japanese Encephalitis Virus

Japanese encephalitis virus is an enveloped positive sense single-stranded RNA virus belonging to Flavivirus family and closely related to St. Louis encephalitis and West Nile virus. The virus causes Japanese encephalitis, also known as Japanese B encephalitis. In majority of cases, the disease is symptomless. However, in less than 1% of infections, the disease leads to a life-threatening encephalitis. The early stage symptoms include fever, headache and malaise. As the disease progresses into an acute encephalitis, the symptoms include neck rigidity, cachexia, hemiparesis, convulsions and fever, accompanied by lifelong neurological problems such as deafness, and/or mental retardation. The disease is transmitted to humans via mosquitos of the *Culex* species. The virus exists in a transmission cycle between mosquitos, pigs, and water birds. The disease affects 24 countries in the South-East Asia and Western Pacific. According to the WHO, an estimated 68 000 clinical cases are reported annually, with case-fatality rate as high as 30%. Major outbreaks of the disease occur every 2-15 years.

The disease may be prevented by a vaccination, most common vaccination being a live attenuated vaccine. In general, the vaccines initially show high effectiveness, but the protection decreases over time. As of today, there is no specific treatment for the disease. Current treatment therapies include good supportive care. There remains a need for longer lasting, improved prevention therapies, and treatment for Japanese encephalitis virus infections.

Antibodies for treatment of Japanese encephalitis have been developed. For example, Hsieh et al, teach antibodies that target cellular receptors and interrupts their function in flavivirus infections in US Patent publication US20080292644, the contents of which are incorporated herein by reference in their entirety.

In some embodiment, methods of the present invention may be used to prevent, manage and/or treat infections and complications caused by Japanese encephalitis virus.

AAV particles and methods of using the AAV particles described in the present invention may be used to prevent, manage and/or treat Japanese encephalitis virus related infections and/or conditions. As a non-limiting example, the AAV particles of the present invention comprise a nucleic acid sequence encoding at least one of the sequences described in Table 20 (SEQ ID NO: 3333, 3359, 3393, 3418, 3442, 4025-4137).

St. Louis Encephalitis Virus

St. Louis encephalitis virus is a positive-stranded RNA virus and member of the Flavivirus family and closely related to Japanese encephalitis virus St Louis encephalitis is a mosquito-borne disease caused by the virus. In majority of cases, the disease is symptomless. However, in less than 1% of the cases, the disease may lead to encephalitis, which may be life-threatening, especially for the elderly. The early stage symptoms include fever, headache, dizziness, malaise and nausea. If the disease progresses to the central nervous system, symptoms include stiff neck, confusion, disorientation, dizziness, tremor and unsteadiness, and in severe cases coma or even death. St. Louis encephalitis virus is transmitted to humans through *Culex* mosquitos. The virus exists in a transmission cycle between mosquitos and birds. The disease mainly affects the USA, especially eastern and central states. The disease has also spread to Canada and Mexico.

As of today, there is no vaccine or specific treatment for St. Louis encephalitis. Current treatment therapies include good supportive care. There is a demand for preventive and treatment therapies for the disease. Neutralizing antibodies for St. Louis encephalitis virus have been reported in Thibodeaux, B. A. et al, 2012, *Antiviral Res* 94 (1), 1-8 and Daffis, S. et al., 2005, *Virology* 337 (2), 262-272, the contents of which are incorporated herein by reference in their entirety.

In some embodiment, methods of the present invention may be used to prevent, manage and/or treat infections and complications caused by St. Louis encephalitis virus.

AAV particles and methods of using the AAV particles described in the present invention may be used to prevent, manage and/or treat St. Louis encephalitis virus related infections and/or conditions. As a non-limiting example, the AAV particles of the present invention comprise a nucleic acid sequence encoding at least one of the sequences described in Table 20 (SEQ ID NO: 3333, 3359, 3393, 3418, 3442, 4025-4137).

Therapeutic Application: Foodborne Illness and Gastroenteritis

AAV particles and methods of using the AAV particles described in the present invention may be used to prevent, manage and/or treat infectious disease. As a non-limiting example, the AAV particles of the present invention comprise a nucleic acid sequence encoding at least one of the sequences described in Tables 3-9 (SEQ ID NO: 2948-3326).

Foodborne illnesses, also known as food poisoning, are a common and costly public health problem. The illnesses are typically transmitted by the fecal-oral-route. The transmission to humans is by consuming contaminated food or beverage More than 250 different foodborne diseases, mostly infections caused by viruses, bacteria, parasites or fungus, are identified by the CDC, CDC estimates that approximately 48 million individuals are affected by foodborne illnesses annually in the United States. Gastroenteritis is an inflammation of the gastrointestinal tract involving stomach and small intestine. Gastroenteritis is also caused by an infection caused by viruses, bacteria, parasites or fungus. The transmission to humans is by person-to-person contact, or by consuming contaminated food or beverage. Foodborne illnesses and gastroenteritis have similar symptoms including diarrhea, vomiting, abdominal pain, dehydration. In some cases, the diseases may require hospitalization or be fatal. Both illnesses are best prevented by proper hand hygiene, proper hygiene while preparing food, treatments to kill bacteria such as pasteurizing, cooking or heating food, and proper methods to store food.

Rotavirus

Rotavirus is a double-stranded RNA virus belonging to the family of Reoviridae. The rotavirus genome consists of 10 segments coding for a single protein, and segment 11 coding for two proteins. The virions are non-enveloped, triple-layered and icosahedral in structure (see, e.g. Aiyegbo et al., 2013, *Plos One* 8, 61101, and references therein). The virus is spread by the fecal-oral-route. Rotavirus is very common especially among infants and young children and spreads easily. Almost all children worldwide are infected with rotavirus by the age of 5, and the disease leads to death of half a million children annually. Rotavirus causes rotavirus gastroenteritis with symptoms including nausea, vomiting, diarrhea and fever. Rotavirus is associated with dehydration. The disease is milder in adults and more severe in young children, infants and the elderly. Though infection does not provide full immunity to the virus, the first infection is typically the most severe in symptoms.

As of today, there is no specific treatment rotavirus infections. Present treatment includes good supportive care including drinking of fluids to prevent dehydration. In severe cases, the rotavirus gastroenteritis requires hospital care e.g. treatment with intravenous fluids. Vaccines for prevention of the disease have been developed and CDC recommends rotavirus vaccination for infants as part of the routine vaccinations There remains a need for medical treatment therapies for the infection. Development has been done in the field of antibodies. E.g. Aiyegbo et al., in Plos One 8, 61101 (2013, teach antibodies targeting the intermediate capsid layer of VP6 of the triple-layered particle and Frenken et al, teach anti-rotavirus antibodies in U.S. Pat. No. 8,105,592, the contents of which are incorporated herein by reference in their entirety.

In some embodiment, methods of the present invention may be used to prevent, manage and/or treat infections and complications caused by rotavirus.

AAV particles and methods of using the AAV particles described in the present invention may be used to prevent, manage and/or treat rotavirus related infections and/or conditions. As a non-limiting example, the AAV particles of the present invention comprise a nucleic acid sequence encoding at least one of the sequences described in Table 8 (SEQ ID NO: 3286-3310).

Norwalk Virus/Norovirus

Norwalk virus, also known as winter vomiting bug, is the only member of genus norovirus belonging to the family of Caliciviridae Norwalk virus is a single-stranded RNA with three open-reading frames that encode a polyprotein precursor to non-structural proteins, and two polypeptides of different sizes (see e.g. Jiang et al., 1993, Virology; 195(1): 51-61, and references therein) Norwalk virus is spread by the fecal-oral-route Norwalk virus is extremely contagious and can be transmitted through contaminated food or drink, touching contaminated surfaces or objects or from a contact with an infected individual. The Norwalk virus causes an inflammation of stomach and/or intestines. The symptoms associated with the infection include stomach pain, nausea, vomiting and diarrhea. The disease can be dangerous, especially for your children or young adults. According to CDC, every year 19-21 million infections occur leading to 570-800 deaths in the US.

As of today, there is no vaccine or specific treatment for Norwalk virus associated gastroenteritis. Antibodies for prevention and treatment of Norwalk virus have been developed. For example, International Patent publication WO2014126921 and WO2014183052, the contents of each of which are incorporated herein by reference in their entirety, teach neutralizing antibodies binding to the polypeptides of Norwalk virus.

In some embodiment, methods of the present invention may be used to prevent, manage and/or treat infections and complications caused by Norwalk virus.

AAV particles and methods of using the AAV particles described in the present invention may be used to prevent, manage and/or treat Norwalk virus related infections and/or conditions. As a non-limiting example, the AAV particles of the present invention comprise a nucleic acid sequence encoding at least one of the sequences described in Table 7 (SEQ ID NO. 3238-3285).

Campylobacter jejuni

Campylobacter jejuni (C. jejuni) is an oxidase-positive, catalase-positive, nonfermentative Gram-negative bacteria with a helical shape. The C. jejuni inhabits in the intestinal tract of animals (e.g. poultry, cattle, pigs, sheep, ostriches and shellfish), and in pets (e.g. cats and dogs). The bacteria may be transmitted to humans foodborne, e.g, when eating contaminated food or drink, such as unpasteurized milk. According to the WHO, campylobacter is the most common cause of gastroenteritis worldwide C. jejuni causes campylobacteriosis infection. The typical symptoms include diarrhea with blood in the feces, abdominal pain, fever, headache, nausea and/or vomiting. The infection may be dangerous to young children, the elderly and individuals with immunodeficiency and is most abundant with malnourished children. C. jejuni infections have been associated with severe long-term complications such as Guillain-Barre Syndrome, inflammatory bowel disease and reactive arthritis (see, e.g., Platts-Mills and Kosek, 2014, Curr Opin Infect Dis; 27(5): 444-450, and references therein).

Typically, C. jejuni infection does not require specific treatment in addition to good supportive care. In more severe cases, in humans and in poultry, the infection has been treated with antibiotics such as fluoroquinoles and macrolides. However, spread of antibiotic-resistant strains is an increasing concern. The treatment with antibiotics is recommended in cases where the bacteria has invaded the intestinal mucosa cell and damaged the tissues, or to eliminate the carrier state. There remains a need for prevention therapies, as well as improved, non-antibiotic, therapies for treatment of the infection Antibodies targeting C. jejuni have been taught e.g. in International Patent publication WO2014063253, the contents of which are incorporated herein by reference in their entirety.

In some embodiment, methods of the present invention may be used to prevent, manage and/or treat infections and complications caused by C. jejuni.

AAV particles and methods of using the AAV particles described in the present invention may be used to prevent, manage and/or treat C. jejuni related infections and/or conditions. As a non-limiting example, the AAV particles of the present invention comprise a nucleic acid sequence encoding at least one of the sequences described in Table 4 (SEQ ID NO: 3089-3098).

Clostridium difficile

Clostridium difficile bacteria (C. difficile) is a Gram-positive, anaerobic spore-forming bacteria belonging to the genus of Clostridium. C. difficile inhabits in the soil. C. difficile produces toxins, most commonly enterotoxin A and cytotoxin B. Toxins A and B both have a C-terminal receptor-binding domain containing repeating sequences, a central hydrophobic domain and N-terminal glucosyltranferase domain. The toxins bind to the intestinal epithelial cells leading to glucosylation of target Rho GTPases, disruption of the cytoskeleton and cell death. C. difficile toxins A and B are a common cause C. difficile associated diarrhea and Clostridium difficile colitis, which is an inflammation of the large intestine. Typical symptoms of the colitis include flu-like symptoms, bloating, diarrhea, and/or abdominal pain. The disease may lead to dehydration, kidney failure, bowel perforation, toxic megacolon resulting in colon rupture. The elderly and individuals with a weakened immunity are more susceptible to severe and recurring infections which can be life-threatening. C. difficile is transmitted by the fecal-oral-route. Due to the ability to form heat-resistant spores, the bacteria is not killed by alcohol-based cleansers or routine surface cleaning. The bacteria may be cultured on almost any surface and survives in clinical environments, such as hospitals. C. difficile is one of the most common and severe healthcare-associated infections. According to CDC, an estimated about half a million infections occur in the United States annually. In 2011, 29, 000 deaths related to C. difficile were reported.

Currently C. difficile infections are treated with antibiotics such as vanconmycin and metronidazole. However, increasing an antibiotic-resistance to the bacteria is a concern. Especially in cases of recurring infections, antibiotic treatments have an incomplete response and they disrupt the normal colonic flora. There remains a need for prevention and improved treatment therapies for the infection. Antibodies targeting C. difficile have been developed. For example, actoxumab and bezlotoxumab (developed by Medarex Inc and the University of Massachusetts Medical School) are human monoclonal antibodies targeting *C. difficile* toxin A and toxin B, respectively. The antibodies may be administered as a combination for the prevention of recurring *C. difficile* infection.

In some embodiment, methods of the present invention may be used to prevent, manage and/or treat infections and complications caused by *C. difficile*.

AAV particles and methods of using the AAV particles described in the present invention may be used to prevent, manage and/or treat *C. difficile* related infections and/or conditions. As a non-limiting example, the AAV particles of the present invention comprise a nucleic acid sequence encoding at least one of the sequences described in Table 3 (SEQ ID NO: 2948-3088).

*Entamoeba histolytica*

*Entamoeba histolytica* (*E. histolytica*) is an anaerobic one-celled parasite protozoan belonging to the genus of *Entamoeba*. The active stage of the protozoan exists only in the host and in fresh feces. Cysts survive outside the host in water, soil and food in moist conditions. *E. histolytica* causes an infection called amebiasis, also known as ameobiasis or entamoebiasis. In majority of cases, amebiasis is symptomless. In 10-20% of individuals infected have symptoms that include loose feces, stomach pain and cramping. The severe more form of amebiasis called amebic dysentery is associated with stomach pain, blood stools and fever. In rare cases. *E. histolytica* invades the liver, forms an abscess and may spread to other parts of the body, such as the lungs or brain. The transmission to humans is mostly via the fecal-oral-route. The disease is typically caused by ingestion of mature cysts in contaminated food, water or via hands. The disease may also be transmitted in close person-to-person contact, e.g. sexual contact. *E. histolytica* infections are most common in tropical areas and especially in poor sanitary conditions. It is estimated that 50 million cases of amebiasis occur annually, leading to 100, 000 deaths.

As of today, there are no preventive vaccines for *E. histolytica* infections, though cellular immunity is important for the prevention of liver invasive amebiasis. Amebiasis is typically treated with amebicides, which are medicines targeting *E. histolytica* at specific parts of the body, e.g. the intestine tissue or liver. Optionally, the treatment may involve one or more antibiotics, as well as steroids. However, increasing antibiotic-resistance of *E. histolytica* is a concern. There remains a need for prevention therapy as well as for improved treatments. Antibodies targeting *E. histolytica* are taught in, e.g., 2009, *Infect. Immun.*; 77(1): 549-556, and Tachibana et al., 1999, *Clin Diagn Lab Immunol.*; 6(3):383-7, the contents of which are incorporated herein by reference in their entirety.

In some embodiment, methods of the present invention may be used to prevent, manage and/or treat infections and complications caused by *E. histolytica*.

AAV particles and methods of using the AAV particles described in the present invention may be used to prevent, manage and/or treat *E. histolytica* related infections and/or conditions. As a non-limiting example, the AAV particles of the present invention comprise a nucleic acid sequence encoding at least one of the sequences described in Table 9 (SEQ ID NO: 3311-3326).

*Helicobacter pylori*

*Helicobacter pylori* (*H. pylori*) is a Gram-negative, spiral-shaped microaerophilic bacterium. *H. pylori* infection is typically asymptomatic and is suggested to be transmitted through the fecal-oral route or oral-oral route. According to CDC, two-thirds of the world's population is infected with *H. pylori*. The infection may cause chronic active, chronic, persistent, and atrophic gastritis, duodenal and gastric ulcers and is associated with cancer. CDC reposts 25 million Americans suffering from an ulcer during their lifetime. Typical symptoms associated with ulcer are gnawing or burning pain in the epigastrium, especially between meals. Additional symptoms include nausea, vomiting, loss of appetite, internal bleeding leading to anemia and fatigue.

Typical treatment for *H. pylori* infection involves antibiotics. Increasing antibiotic resistance and patient noncompliance are major challenges associated with the antibiotic treatment. There remains a need for improved, non-antibiotic, treatment and prevention therapies targeting *H. pylori*. Antibodies targeting *H. pylori* infection have been developed. For example. Boren et al, teach antibodies targeting the BAbA antigen expressed by *H. pylori* in US patent U.S. Pat. No. 8,025,880, the contents of which are incorporated herein by reference in their entirety.

In some embodiment, methods of the present invention may be used to prevent, manage and/or treat infections and complications caused by *H. pylori*.

AAV particles and methods of using the AAV particles described in the present invention may be used to prevent, manage and/or treat *H. pylori* related infections and/or conditions. As a non-limiting example, the AAV particles of the present invention comprise a nucleic acid sequence encoding at least one of the sequences described in Table 5 (SEQ ID NO: 3099-3196).

Enterotoxin B

Enterotoxin B is a toxin produced by certain strains of Gram-positive bacteria *Staphylococcus aureus* and is a common cause for food poisoning. *Staphylococcus* species thrive and produce toxins in unrefrigerated meats, dairy, and bakery products. The symptoms associated with enterotoxin B infection are severe diarrhea, nausea and intestinal cramping. The toxin may remain active in the human body after the bacteria has been killed. Enterotoxin B is a so-called superantigen. Superantigens are toxins that may activate T cells by forming a bridge between a MHC II on antigen presenting cells (APCs) and the T cell receptors (TCR). Due to binding of enterotoxin B, the T cells release large amount of cytokines leading to an inflammation and gastroenteritis. Though enterotoxin B infection is typically not life threatening, enterotoxin B has been identified as a potential chemical and biological warfare agent.

As of today, there is no specific prevention or treatment for enterotoxin B infection. Antibodies that neutralize enterotoxin B have been investigated, e.g. as described in U.S. Pat. No. 8,895,704.

In some embodiment, methods of the present invention may be used to prevent, manage and/or treat infections and complications caused by enterotoxin B.

AAV particles and methods of using the AAV particles described in the present invention may be used to prevent, manage and/or treat enterotoxin B related infections and/or conditions. As a non-limiting example, the AAV particles of the present invention comprise a nucleic acid sequence encoding at least one of the sequences described in Table 5 (SEQ ID NO: 3099-3196).

V. Kits and Devices

Kits

In one embodiment, the invention provides a variety of kits for conveniently and/or effectively carrying out methods of the present invention. Typically, kits will comprise sufficient amounts and/or numbers of components to allow a user to perform multiple treatments of a subject(s) and/or to perform multiple experiments.

Any of the AAV particles of the present invention may be comprised in a kit. In some embodiments, kits may further include reagents and/or instructions for creating and/or synthesizing compounds and/or compositions of the present invention. In some embodiments, kits may also include one or more buffers. In some embodiments, kits of the invention may include components for making protein or nucleic acid arrays or libraries and thus, may include, for example, solid supports.

In some embodiments, kit components may be packaged either in aqueous media or in lyophilized form. The container means of the kits will generally include at least one vial, test tube, flask, bottle, syringe or other container means, into which a component may be placed, and preferably, suitably aliquoted. Where there is more than one kit component. (labeling reagent and label may be packaged together), kits may also generally contain second, third or other additional containers into which additional components may be separately placed. In some embodiments, kits may also comprise second container means for containing sterile, pharmaceutically acceptable buffers and/or other diluents. In some embodiments, various combinations of components may be comprised in one or more vial. Kits of the present invention may also typically include means for containing compounds and/or compositions of the present invention, e.g., proteins, nucleic acids, and any other reagent containers in close confinement for commercial sale. Such containers may include injection or blow-molded plastic containers into which desired vials are retained.

In some embodiments, kit components are provided in one and/or more liquid solutions. In some embodiments, liquid solutions are aqueous solutions, with sterile aqueous solutions being particularly preferred. In some embodiments, kit components may be provided as dried powder(s). When reagents and/or components are provided as dry powders, such powders may be reconstituted by the addition of suitable volumes of solvent. In some embodiments, it is envisioned that solvents may also be provided in another container means. In some embodiments, labeling dyes are provided as dried powders. In some embodiments, it is contemplated that 10, 20, 30, 40, 50, 60, 70, 80, 90, 100, 120, 120, 130, 140, 150, 160, 170, 180, 190, 200, 300, 400, 500, 600, 700, 800, 900, 1000 micrograms or at least or at most those amounts of dried dye are provided in kits of the invention. In such embodiments, dye may then be resuspended in any suitable solvent, such as DMSO.

In some embodiments, kits may include instructions for employing kit components as well the use of any other reagent not included in the kit. Instructions may include variations that may be implemented.

Devices

In one embodiment, the AAV particles may delivered to a subject using a device to deliver the AAV particles and a head fixation assembly. The head fixation assembly may be, but is not limited to, any of the head fixation assemblies sold by MRI interventions. As a non-limiting example, the head fixation assembly may be any of the assemblies described in U.S. Pat. Nos. 8,099,150, 8,548,569 and 9,031,636 and International Patent Publication Nos. WO201108495 and WO2014014585, the contents of each of which are incorporated by reference in their entireties. A head fixation assembly may be used in combination with an MRI compatible drill such as, but not limited to, the MRI compatible drills described in International Patent Publication No. WO2013181008 and US Patent Publication No US20130325012, the contents of which are herein incorporated by reference in its entirety.

In one embodiment, the AAV particles may be delivered using a method, system and/or computer program for positioning apparatus to a target point on a subject to deliver the AAV particles. As a non-limiting example, the method, system and/or computer program may be the methods, systems and/or computer programs described in U.S. Pat. No. 8,340,743, the contents of which are herein incorporated by reference in its entirety. The method may include: determining a target point in the body and a reference point, wherein the target point and the reference point define a planned trajectory line (PTL) extending through each; determining a visualization plane, wherein the PTL intersects the visualization plane at a sighting point; mounting the guide device relative to the body to move with respect to the PTL, wherein the guide device does not intersect the visualization plane; determining a point of intersection (GPP) between the guide axis and the visualization plane; and aligning the GPP with the sighting point in the visualization plane.

In one embodiment, the AAV particles may be delivered using an MRI-guided device Non-limiting examples of MRI-guided devices are described in U.S. Pat. Nos. 9,055,884, 9,042,958, 8,886,288, 8,768,433, 8,396,532, 8,369,930, 8,374,677 and 8,175,677 and US Patent Application No. US20140024927 the contents of each of which are herein incorporated by reference in their entireties. As a non-limiting example, the MRI-guided device may be able to provide data in real time such as those described in U.S. Pat. Nos. 8,886,288 and 8,768,433, the contents of each of which is herein incorporated by reference in its entirety. As another non-limiting example, the MRI-guided device or system may be used with a targeting cannula such as the systems described in U.S. Pat. Nos. 8,175,677 and 8,374,677, the contents of each of which are herein incorporated by reference in their entireties. As yet another non-limiting example, the MRI-guided device includes a trajectory guide frame for guiding an interventional device as described, for example, in U.S. Pat. No. 9,055,884 and US Patent Application No. US20140024927, the contents of each of which are herein incorporated by reference in their entireties.

In one embodiment, the AAV particles may be delivered using an MRI-compatible tip assembly. Non-limiting examples of MRI-compatible tip assemblies are described in US Patent Publication No. US20140275980, the contents of which is herein incorporated by reference in its entirety.

In one embodiment, the AAV particles may be delivered using a cannula which is MRI-compatible. Non-limiting examples of MRI-compatible cannulas include those taught in International Patent Publication No. WO2011130107, the contents of which are herein incorporated by reference in its entirety.

In one embodiment, the AAV particles may be delivered using a catheter which is MRI-compatible. Non-limiting examples of MRI-compatible catheters include those taught in International Patent Publication No. WO02012116265, U.S. Pat. No. 8,825,133 and US Patent Publication No. US20140024909, the contents of each of which are herein incorporated by reference in their entireties.

In one embodiment, the AAV particles may be delivered using a device with an elongated tubular body and a diaphragm as described in US Patent Publication Nos US20140276582 and US20140276614, the contents of each of which are herein incorporated by reference in their entireties.

In one embodiment, the AAV particles may be delivered using an MRI compatible localization and/or guidance system such as, but not limited to, those described in US Patent Publication Nos. US20150223905 and US20150230871, the contents of each of which are herein incorporated by reference in their entireties. As a non-limiting example, the MRI compatible localization and/or guidance systems may comprise a mount adapted for fixation to a patient, a targeting cannula with a lumen configured to attach to the mount so as to be able to controllably translate in at least three dimensions, and an elongate probe configured to snugly advance via slide and retract in the targeting cannula lumen, the elongate probe comprising at least one of a stimulation or recording electrode.

In one embodiment, the AAV particles may be delivered to a subject using a trajectory frame as described in US Patent Publication Nos. US20150031982 and US20140066750 and International Patent Publication Nos. WO2015057807 and WO2014039481, the contents of each of which are herein incorporated by reference in their entireties.

In one embodiment, the AAV particles may be delivered to a subject using a gene gun.

VI. Definitions

At various places in the present specification, substituents of compounds of the present disclosure are disclosed in groups or in ranges. It is specifically intended that the present disclosure include each and every individual subcombination of the members of such groups and ranges.

About: As used herein, the term "about" means+/−10% of the recited value.

Adeno-associated virus. The term "adeno-associated virus" or "AAV" as used herein refers to members of the dependovirus genus comprising any particle, sequence, gene, protein, or component derived therefrom.

AAV Particle: As used herein, an "AAV particle" is a virus which comprises a viral genome with at least one payload region and at least one ITR region, AAV vectors of the present disclosure may be produced recombinantly and may be based on adeno-associated virus (AAV) parent or reference sequences, AAV particle may be derived from any serotype, described herein or known in the art, including combinations of serotypes (i.e., "pseudotyped" AAV) or from various genomes (e.g., single stranded or self-complementary). In addition, the AAV particle may be replication defective and/or targeted.

Activity: As used herein, the term "activity" refers to the condition in which things are happening or being done. Compositions of the invention may have activity and this activity may involve one or more biological events.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Amelioration: As used herein, the term "amelioration" or "ameliorating" refers to a lessening of severity of at least one indicator of a condition or disease. For example, in the context of neurodegeneration disorder, amelioration includes the reduction of neuron loss.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g. a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antibody: As used herein, the term "antibody" is referred to in the broadest sense and specifically covers various embodiments including, but not limited to monoclonal antibodies, polyclonal antibodies, multispecific antibodies (e.g. bispecific antibodies formed from at least two intact antibodies), and antibody fragments (e.g., diabodies) so long as they exhibit a desired biological activity (e.g., "functional"). Antibodies are primarily amino-acid based molecules but may also comprise one or more modifications (including, but not limited to the addition of sugar moieties, fluorescent moieties, chemical tags, etc.). Non-limiting examples of antibodies or fragments thereof include $V_H$ and $V_L$ domains, scFvs, Fab, Fab', F(ab')$_2$, Fv fragment, diabodies, linear antibodies, single chain antibody molecules, multispecific antibodies, bispecific antibodies, intrabodies, monoclonal antibodies, polyclonal antibodies, humanized antibodies, codon-optimized antibodies, tandem scFv antibodies, bispecific T-cell engagers, mAb2 antibodies, chimeric antigen receptors (CAR), tetravalent bispecific antibodies, biosynthetic antibodies, native antibodies, miniaturized antibodies, unibodies, maxibodies, antibodies to senescent cells, antibodies to conformers, antibodies to disease specific epitopes or antibodies to innate defense molecules.

Antibody-based composition: As used herein, "antibody-based" or "antibody-derived" compositions are monomeric or multi-meric polypeptides which comprise at least one amino-acid region derived from a known or parental antibody sequence and at least one amino acid region derived from a non-antibody sequence, e.g., mammalian protein.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g. physiological conditions. An "association" need not be strictly through direct covalent chemical bonding. It may also suggest ionic or hydrogen bonding or a hybridization based connectivity sufficiently stable such that the "associated" entities remain physically associated.

Bifunctional. As used herein, the term "bifunctional" refers to any substance, molecule or moiety which is capable of or maintains at least two functions. The functions may effect the same outcome or a different outcome. The structure that produces the function may be the same or different.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, an AAV particle of the present invention may be considered biologically active if even a portion of the encoded payload is biologically active or mimics an activity considered biologically relevant.

Capsid: As used herein, the term "capsid" refers to the protein shell of a virus particle.

Chimeric antigen receptor (C4R). As used herein, the term "chimeric antigen receptor" or "CAR" refers to an artificial chimeric protein comprising at least one antigen specific targeting region (ASTR), a transmembrane domain and an intracellular signaling domain, wherein the antigen specific targeting region comprises a full-length antibody or a fragment thereof. As a non-limiting example the ASTR of a CAR may be any of the antibodies listed in Tables 3-42, antibody-based compositions or fragments thereof. Any molecule that is capable of binding a target antigen with high affinity can be used in the ASTR of a CAR, The CAR may optionally have an extracellular spacer domain and/or a co-stimulatory domain. A CAR may also be used to generate a cytotoxic cell carrying the CAR.

Complementary and substantially complementary: As used herein, the term "complementary" refers to the ability of polynucleotides to form base pairs with one another. Base pairs are typically formed by hydrogen bonds between nucleotide units in antiparallel polynucleotide strands. Complementary polynucleotide strands can form base pair in the Watson-Crick manner (e.g., A to T, A to U, C to G), or in any other manner that allows for the formation of duplexes. As persons skilled in the art are aware, when using RNA as opposed to DNA, uracil rather than thy mine is the base that is considered to be complementary to adenosine However, when a U is denoted in the context of the present invention, the ability to substitute a T is implied, unless otherwise stated. Perfect complementarity or 100% complementarity refers to the situation in which each nucleotide unit of one polynucleotide strand can form hydrogen bond with a nucleotide unit of a second polynucleotide strand. Less than perfect complementarity refers to the situation in which some, but not all, nucleotide units of two strands can form hydrogen bond with each other. For example, for two 20-mers, if only two base pairs on each strand can form hydrogen bond with each other, the polynucleotide strands exhibit 10% complementarity. In the same example, if 18 base pairs on each strand can form hydrogen bonds with each other, the polynucleotide strands exhibit 90% complementarity. As used herein, the term "substantially complementary" means that the siRNA has a sequence (e.g., in the antisense strand) which is sufficient to bind the desired target mRNA, and to trigger the RNA silencing of the target mRNA.

Compound Compounds of the present disclosure include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Comprehensive Positional Evolution (CPE™): As used herein, the term "comprehensive positional evolution" refers to an antibody evolution technology that allows for mapping of the effects of amino acid changes at every position along an antibody variable domain's sequence. This comprehensive mutagenesis technology can be used to enhance one or more antibody properties or characteristics.

Comprehensive Protein Synthesis (CPS™): As used herein, the term "comprehensive protein synthesis" refers to a combinatorial protein synthesis technology that can be used to optimize antibody properties or characteristics by combining the best properties into a new, high-performance antibody.

Conditionally active: As used herein, the term "conditionally active" refers to a mutant or variant of a wild-type polypeptide, wherein the mutant or variant is more or less active at physiological conditions than the parent polypeptide. Further, the conditionally active polypeptide may have increased or decreased activity at aberrant conditions as compared to the parent polypeptide. A conditionally active polypeptide may be reversibly or irreversibly inactivated at normal physiological conditions or aberrant conditions.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of a polynucleotide or polypeptide or may apply to a portion, region or feature thereof.

Control Elements: As used herein, "control elements", "regulatory control elements" or "regulatory sequences" refers to promoter regions, polyadenylation signals, transcription termination sequences, upstream regulatory domains, origins of replication, internal ribosome entry sites ("IRES"), enhancers, and the like, which provide for the replication, transcription and translation of a coding sequence in a recipient cell. Not all of these control elements need always be present as long as the selected coding sequence is capable of being replicated, transcribed and/or translated in an appropriate host cell.

Controlled Release: As used herein, the term "controlled release" refers to a pharmaceutical composition or compound release profile that conforms to a particular pattern of release to effect a therapeutic outcome.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering an AAV particle, a compound, substance, entity, moiety, cargo or pay load.

Delivery Agent: As used herein, "delivery agent" refers to any substance which facilitates, at least in part, the in vivo delivery of an AAV particle to targeted cells.

Destabilized: As used herein, the term "destable," "destabilize," or "destabilizing region" means a region or molecule that is less stable than a starting, wild-type or native form of the same region or molecule.

Detectable label: As used herein. "detectable label" refers to one or more markers, signals, or moieties which are attached, incorporated or associated with another entity that is readily detected by methods known in the art including radiography, fluorescence, chermluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Encapsulate: As used herein, the term "encapsulate" means to enclose, surround or encase.

Engineered: As used herein, embodiments of the invention are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

Epitope: As used herein, an "epitope" refers to a surface or region on a molecule that is capable of interacting with a biomolecule. For example, a protein may contain one or more amino acids, e.g., an epitope, which interacts with an antibody, e.g., a biomolecule. In some embodiments, when referring to a protein or protein module, an epitope may comprise a linear stretch of amino acids or a three-dimensional structure formed by folded amino acid chains.

EvoMap™: As used herein, an EvoMap™ refers to a map of a polypeptide, wherein detailed informatics are presented about the effects of single amino acid mutations within the length of the polypeptide and their influence on the properties and characteristics of that polypeptide.

Expression: As used herein, "expression" of a nucleic acid sequence refers to one or more of the following events: (1) production of an RNA template from a DNA sequence (e.g., by transcription); (2) processing of an RNA transcript (e.g. by splicing, editing, 5' cap formation, and/or 3' end processing), (3) translation of an RNA into a polypeptide or protein, and (4) post-translational modification of a polypeptide or protein.

Feature: As used herein, a "feature" refers to a characteristic, a property, or a distinctive element.

Formulation: As used herein, a "formulation" includes at least one AAV particle and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Gene expression: The term "gene expression" refers to the process by which a nucleic acid sequence undergoes successful transcription and in most instances translation to produce a protein or peptide. For clarity, when reference is made to measurement of "gene expression", this should be understood to mean that measurements may be of the nucleic acid product of transcription, e.g. RNA or mRNA or of the amino acid product of translation, e.g., polypeptides or peptides. Methods of measuring the amount or levels of RNA, mRNA, polypeptides and peptides are well known in the art.

Homology: As used herein, the term "homology" refers to the overall relatedness between polymeric molecules, e.g. between polynucleotide molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Heterologous Region: As used herein the term "heterologous region" refers to a region which would not be considered a homologous region.

Homologous Region: As used herein the term "homologous region" refers to a region which is similar in position, structure, evolution origin, character, form or function.

Identity: As used herein, the term "identity" refers to the overall relatedness between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed. Oxford University Press, New York; 1988; Biocomputing: Informatics and Genome Projects, Smith, D. W, ed., Academic Press, New York, 1993; Sequence Analysis in Molecular Biology, von Heinje, G., Academic Press, 1987; Computer Analysis of Sequence Data, Part I. Griffin, A. M., and Griffin, H. G., eds., Humana Press, New Jersey, 1994; and Sequence Analysis Primer, Gribskov, M. and Devereux, J., eds., M Stockton Press. New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)). BLASTP. BLASTN, and FASTA Altschul, S. F. et al., *J. Molec. Biol.,* 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically, a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting) Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that a substance is substantially separated from the environment in which it was formed or detected. Partial separation can include, for example, a composition enriched in the substance or AAV particles of the present disclosure. Substantial separation can include compositions containing at least about 50%, at least about 60%, at least about 70%, at least about 80%, at least about 90%, at least about 95%, at least about 97%, or at least about 99%, by weight of the compound of the present disclosure, or salt thereof. Methods for isolating compounds and their salts are routine in the art.

Linker: As used herein "linker" refers to a molecule or group of molecules which connects two molecules, such as a $V_H$ chain and $V_L$ chain or an antibody. A linker may be a nucleic acid sequence connecting two nucleic acid sequences encoding two different polypeptides. The linker may or may not be translated. The linker may be a cleavable linker.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally.

Naturally Occurring: As used herein. "naturally occurring" or "wild-type" means existing in nature without artificial aid, or involvement of the hand of man.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Particle: As used herein, a "particle" is a virus comprised of at least two components, a protein capsid and a polynucleotide sequence enclosed within the capsid.

Patient: As used herein. "patient" refers to a subject who may seek or be in need of treatment, requires treatment, is receiving treatment, will receive treatment, or a subject who is under care by a trained professional for a particular disease or condition.

Payload: As used herein, "payload" or "payload region" refers to one or more polynucleotides or polynucleotide regions encoded by or within a viral genome or an expression product of such polynucleotide or polynucleotide region, e.g., a transgene, a polynucleotide encoding a polypeptide or multi-polypeptide or a modulatory nucleic acid or regulatory nucleic acid.

Payload construct: As used herein, "payload construct" is one or more polynucleotide regions encoding or comprising a payload that is flanked on one or both sides by an inverted terminal repeat (ITR) sequence. The payload construct is a template that is replicated in a viral production cell to produce a viral genome.

Payload construct vector. As used herein, "payload construct vector" is a vector encoding or comprising a payload construct, and regulatory regions for replication and expression in bacterial cells.

Payload construct expression vector: As used herein, a "payload construct expression vector" is a vector encoding or comprising a payload construct and which further comprises one or more polynucleotide regions encoding or comprising components for viral expression in a viral replication cell.

Peptide: As used herein, "peptide" is less than or equal to 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient." as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked poly vinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines: alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two: generally, nonaqueous media like ether, ethyl acetate, ethanol, isopropanol, or acetonitrile are preferred. Lists of suitable salts are found in *Remington's Pharmaceutical Sciences*. 17$^{th}$ ed., Mack Publishing Company, Easton, Pa., 1985, p. 1418. *Pharmaceutical Salts: Properties. Selection, and Use*, P. H Stahl and C. G. Wermuth (eds.). Wiley-VCH, 2008, and Berge et al., *Journal of Pharmaceutical Science,* 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body: (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition, partially or completely delaying onset of one or more symptoms, features, or manifestations of a particular infection, disease, disorder, and/or condition, partially or completely delaying progression from an infection, a particular disease, disorder and/or condition; and/or decreasing the risk of developing pathology associated with the infection, the disease, disorder, and/or condition.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative processes.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Purified: As used herein, "purify," "purified," "purification" means to make substantially pure or clear from unwanted components, material defilement, admixture or imperfection. "Purified" refers to the state of being pure. "Purification" refers to the process of making pure.

Region: As used herein, the term "region" refers to a zone or general area. In some embodiments, when referring to a protein or protein module, a region may comprise a linear sequence of amino acids along the protein or protein module or may comprise a three-dimensional area, an epitope and/or a cluster of epitopes. In some embodiments, regions comprise terminal regions. As used herein, the term "terminal region" refers to regions located at the ends or termini of a given agent. When referring to proteins, terminal regions may comprise N- and/or C-termini. N-termini refer to the end of a protein comprising an amino acid with a free amino group. C-termini refer to the end of a protein comprising an amino acid with a free carboxyl group. N- and/or C-terminal regions may there for comprise the N- and/or C-termini as well as surrounding amino acids. In some embodiments. N- and/or C-terminal regions comprise from about 3 amino acid to about 30 amino acids, from about 5 amino acids to about 40 amino acids, from about 10 amino acids to about 50 amino acids, from about 20 amino acids to about 100 amino acids and/or at least 100 amino acids. In some embodiments, N-terminal regions may comprise any length of amino acids that includes the N-terminus, but does not include the C-terminus. In some embodiments. C-terminal regions may comprise any length of amino acids, which include the C-terminus, but do not comprise the N-terminus.

In some embodiments, when referring to a polynucleotide, a region may comprise a linear sequence of nucleic acids along the polynucleotide or may comprise a three-dimensional area, secondary structure, or tertiary structure. In some embodiments, regions comprise terminal regions. As used herein, the term "terminal region" refers to regions located at the ends or termini of a given agent. When referring to polynucleotides, terminal regions may comprise 5' and 3' termini, 5' termini refer to the end of a polynucleotide comprising a nucleic acid with a free phosphate group, 3' termini refer to the end of a polynucleotide comprising a nucleic acid with a free hydroxyl group, 5' and 3' regions may there for comprise the 5' and 3' termini as well as surrounding nucleic acids. In some embodiments, 5' and 3' terminal regions comprise from about 9 nucleic acids to about 90 nucleic acids, from about 15 nucleic acids to about 120 nucleic acids, from about 30 nucleic acids to about 150 nucleic acids, from about 60 nucleic acids to about 300 nucleic acids and/or at least 300 nucleic acids. In some embodiments, 5' regions may comprise any length of nucleic acids that includes the 5' terminus, but does not include the 3' terminus. In some embodiments, 3' regions may comprise any length of nucleic acids, which include the 3' terminus, but does not comprise the 5' terminus.

RNA or RNA molecule: As used herein, the term "RNA" or "RNA molecule" or "ribonucleic acid molecule" refers to a polymer of ribonucleotides; the term "DNA" or "DNA molecule" or "deoxyribonucleic acid molecule" refers to a polymer of deoxyribonucleotides. DNA and RNA can be synthesized naturally, e.g., by DNA replication and transcription of DNA, respectively; or be chemically synthesized. DNA and RNA can be single-stranded (i.e., ssRNA or ssDNA, respectively) or multi-stranded (e.g., double stranded, i.e., dsRNA and dsDNA, respectively). The term "mRNA" or "messenger RNA", as used herein, refers to a single stranded RNA that encodes the amino acid sequence of one or more polypeptide chains.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Self-complementary viral particle: As used herein, a "self-complementary viral particle" is a particle comprised of at least two components, a protein capsid and a polynucleotide sequence encoding a self-complementary genome enclosed within the capsid.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event. In some embodiments, a single unit dose is provided as a discrete dosage form (e.g., a tablet, capsule, patch, loaded syringe, vial, etc.).

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject. As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition: (2) a genetic polymorphism associated with development of the disease, disorder, and/or condition: (3) increased and/or decreased expression and/or activity of a protein and/or nucleic acid associated with the disease, disorder, and/or condition; (4) habits and/or lifestyles associated with development of the disease, disorder, and/or condition: (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release. As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present invention may be chemical or enzymatic.

Targeting: As used herein, "targeting" means the process of design and selection of nucleic acid sequence that will hybridize to a target nucleic acid and induce a desired effect.

Targeted Cells: As used herein. "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transfection: As used herein, the term "transfection" refers to methods to introduce exogenous nucleic acids into a cell. Methods of transfection include, but are not limited to, chemical methods, physical treatments and cationic lipids or mixtures.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way Unmodified may, but does not always, refer to the wild type or native form of a biomolecule. Molecules may undergo a series of modifications whereby each modified molecule may serve as the "unmodified" starting molecule for a subsequent modification.

Vector: As used herein, a "vector" is any molecule or moiety which transports, transduces or otherwise acts as a carrier of a heterologous molecule. Vectors of the present invention may be produced recombinantly and may be based on and/or may comprise adeno-associated virus (AAV) parent or reference sequence Such parent or reference AAV sequences may serve as an original, second, third or subsequent sequence for engineering vectors. In non-limiting examples, such parent or reference AAV sequences may comprise any one or more of the following sequences: a polynucleotide sequence encoding a polypeptide or multi-polypeptide, which sequence may be wild-type or modified from wild-type and which sequence may encode full-length or partial sequence of a protein, protein domain, or one or more subunits of a protein; a polynucleotide comprising a modulatory or regulatory nucleic acid which sequence may be wild-type or modified from wild-type; and a transgene that may or may not be modified from wild-type sequence. These AAV sequences may serve as either the "donor" sequence of one or more codons (at the nucleic acid level) or amino acids (at the polypeptide level) or "acceptor" sequences of one or more codons (at the nucleic acid level) or amino acids (at the polypeptide level).

Viral genome: As used herein, a "viral genome" or "vector genome" is a polynucleotide comprising at least one inverted terminal repeat (ITR) and at least one encoded payload. A viral genome encodes at least one copy of the payload.

Described herein are compositions, methods, processes, kits and devices for the design, preparation, manufacture and/or formulation of AAV particles. In some embodiments, payloads, such as but not limited to AAV polynucleotides, may be encoded by payload constructs or contained within plasmids or vectors or recombinant adeno-associated viruses (AAVs).

The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

The present invention is further illustrated by the following non-limiting examples.

VII. Examples

Example 1. Production and Purification of AAV Particles

AAV particles described herein may be produced using methods known in the art, such as, for example, triple transfection or baculovirus mediated virus production. Any suitable permissive or packaging cell known in the art may be employed to produce the vectors Mammalian cells are often preferred. Also preferred are trans-complementing packaging cell lines that provide functions deleted from a replication-defective helper virus, e.g., 293 cells or other E1a trans-complementing cells.

The gene cassette may contain some or all of the parvovirus (e.g., AAV) cap and rep genes. Preferably, however, some or all of the cap and rep functions are provided in trans by introducing a packaging vector(s) encoding the capsid and/or Rep proteins into the cell. Most preferably, the gene cassette does not encode the capsid or Rep proteins. Alternatively, a packaging cell line is used that is stably transformed to express the cap and/or rep genes Recombinant AAV virus particles are, in some cases, produced and purified from culture supernatants according to the procedure as described in US20160032254, the contents of which are incorporated by reference Production may also involve methods known in the art including those using 293T cell, sf9 insect cells, triple transfection or any suitable production method.

In some cases, 293 cells are transfected with CaPO4 with plasmids required for production of AAV, i.e., AAV2 rep, an adenoviral helper construct and a ITR flanked transgene cassette. The AAV2 rep plasmid also contains the cap sequence of the particular virus being studied. Twenty-four hours after transfection, which occurs in serum containing DMEM, the medium is replaced with fresh medium with or without serum. Three (3) days after transfection, a sample is taken from the culture medium of the 293 adherent cells. Subsequently cells are scraped and transferred into a receptacle. After centrifugation to remove cellular pellet, a second sample is taken from the supernatant after scraping. Next cell lysis is achieved by three consecutive freeze-thaw cycles (−80 C. to 37 C.). Cellular debris is removed and sample 3 is taken from the medium. The samples are quantified for AAV particles by DNase resistant genome titration by Taqman™ PCR, The total production yield from such a transfection is equal to the particle concentration from sample 3.

AAV vector titers are measured according to genome copy number (genome particles per milliliter). Genome particle concentrations are based on Taqman® PCR of the vector DNA as previously reported (Clark et al. (1999) Hum. Gene Ther., 10:1031-1039; Veldwijk et al. (2002) Mol. Ther., 6:272-278).

Example 2. Tissue Specific Expression

To evaluate the expression of various encoded antibody payloads in tissues, a series of AAV particles carrying the encoded antibody sequences driven by a panel of ubiquitous and tissue-specific promoters are made. These particles are administered to the specific tissue, e.g., intramuscularly, via an appropriate route, e.g., a single injection in the gastrocnemius muscle and expression is monitored to determine the relative expression potential of the payload as well as of each promoter in this target tissue. Measurement of antibody production is performed using standard techniques, for example by ELISA.

In some cases, the cytomegalovirus immediate early promoter (CMV), chimeric chicken-beta-actin (CAG), and ubiquitin C (UBC), CBA, H1 promoters provide robust expression.

Example 3. Generation of Antibodies

Antibody Production by Hybridoma Technology

Host animals (e.g. mice, rabbits, goats, and llamas) are immunized by an injection with an antigenic protein to elicit lymphocytes that specifically bind to the antigen Lymphocytes are collected and fused with immortalized cell lines to generate hybridomas. Hybridomas are cultured in a suitable culture medium that is enriched with appropriate selection agents to promote growth.

Antibodies produced by the cultured hybridomas are subjected to analysis to determine binding specificity of the antibodies for the target antigen Once antibodies with desirable characteristics are identified, corresponding hybridomas are subcloned through limiting dilution procedures and grown by standard methods. Antibodies produced by these cells are isolated and purified using standard immunoglobulin purification procedures Recombinant Antibody Production Recombinant antibodies are produced using heavy and light chain variable region cDNA sequences selected from hybridomas or from other sources. Sequences encoding antibody variable domains expressed by hybridomas are determined by extracting RNA molecules from antibody-producing hybridoma cells and producing cDNA by reverse transcriptase polymerase chain reaction (PCR). PCR is used to amplify cDNA using primers specific for heavy and light chain sequences. PCR products are then subcloned into plasmids for sequence analysis. Antibodies are produced by insertion of resulting variable domain sequences into expression vectors.

Recombinant antibodies are also produced using phage display technology. Target antigens are screened, in vitro, using phage display libraries having millions to billions of phage particles expressing unique single chain variable fragments (scFvs) on their viral coat. Precipitated phage particles are analyzed and sequences encoding expressed scFvs are determined. Sequences encoding antibody variable domains and/or CDRs are inserted into expression vectors for antibody production.

Recombinant antibodies are further produced using yeast surface display technology, wherein antibody variable domain sequences are expressed on the cell surface of *Saccharomyces cerevisae*. Recombinant antibodies are developed by displaying the antibody fragment of interest as a fusion to e.g. Aga2p protein on the surface of the yeast, where the protein interacts with proteins and small molecules in a solution, scFvs with affinity towards desired receptors are isolated from the yeast surface using magnetic separation and flow cytometry. Several cycles of yeast surface display and isolation will be done to attain scFvs with desired properties through directed evolution.

Example 4. Optimization of the Encoded Antibody

To design an optimal framework for the expression of an antibody, the heavy and light chains of several antibodies separated by an F2A self-processing peptide sequence are cloned into a mammalian expression vector under the control of the CMV promoter. 293T cells or any suitable cell line transfected with these vectors exhibit secretion of human IgG into the culture supernatant that is then detected by ELISA.

To increase expression, the antibody chains and/or the processing peptide are codon optimized for mammalian expression. In some instances, a furin cleavage site at the N-terminus is inserted for better processing.

To improve secretion of the antibody, the endogenous signal sequences are replaced with a sequence which may or may not be codon optimized, derived from any gene. In some cases, the human growth hormone signal sequence is used. Any of the heavy, light or both chains may be driven by any signal sequence, whether the same or different. Antibody expression is confirmed using standard immunohistochemical techniques, including ELISA Example 5. Vectored Antibodies Viral genomes are designed for AAV delivery of antibodies to cells. The viral genome comprises a payload region and at least one inverted terminal repeat (ITR) region. The payload region may optionally encode regulatory elements e.g., a promoter region, an intronic region, or a polyadenylation sequence. The payload region comprises a sequence encoding one or more polypeptides selected from the group consisting of those listed in Table 3. An exemplary payload region comprises a sequence encoding an antibody heavy chain, a region encoding an antibody light chain and a region encoding a linker connecting the heavy and light chain sequences or polypeptides before further processing. A promoter is selected to target the desired tissue or for desired regulation of expression, or both. The promoter may be selected from human EF1α, CMV, CBA, and its derivative CAG, GUSB, UBC, or any other promoter known to one with skill in the art, or combinations thereof. The 5' and 3' ITRs may or may not be of the same serotype as the capsid of the AAV particle.

Payload regions may optionally encode a linker between light and heavy antibody chain sequences or polypeptides. Sequence encoding linkers are derived from an internal ribosome entry site (IRES; SEQ ID NO: 899), foot and mouth disease virus 2A (F2A, SEQ ID NO: 900), porcine teschovirus-1 virus 2A (P2A; SEQ ID NO:901), a furin cleavage site (F: SEQ ID NO: 902), or a 5xG4S (SEQ ID NO: 9221 encoded by SEQ ID NO: 903) linker sequence. In various payload regions, the order of heavy and light chains is alternated with respect to 5' to 3' direction. Payloads are further designed to encode protein signal sequences (to aid in protein processing, localization, and/or secretion) as well as an untranslated poly A tail.

Each viral genome is then incorporated into an AAV cloning vector to create payload expression vectors.

The payload expression vectors are expressed in e.g. Expi 293 cells. The supernatants are collected and expressed antibodies are purified using protein A/G beads. Supernatants are diluted with a loading buffer and applied to a column prepared with A/C beads. Unbound proteins are washed through with loading buffer Elution buffer is added to the column, fractions collected, and fractions containing proteins of interest are identified with absorption spectroscopy technique, pooled together, and neutralized. Western blotting techniques are used to identify payload regions producing the antibody proteins of interest Purified antibodies are then tested for their affinity to their specific target by e.g. ELISA essay technique and antibodies with the highest affinity are identified and selected.

Finally, the rAAVs are produced using, for example, HEK293T cells. The cells are transfected simultaneously with the viral genome of the present invention, a viral genome encoding helper proteins and a viral genome encoding replication and capsid proteins.

Example 6. In Vivo Expression and Efficacy of Antibody Payloads

To determine the efficacy or comparative expression of encoded antibodies, dose-dependent expression is determined at a series of time points. Samples from mice treated with AAV particles encoding antibodies or luciferase at various levels are examined for expression using standard techniques such as nucleic acid analyses for RNA levels, protein analyses for antibody levels and compared to the expression of the luciferase control.

Example 7. Treatment of Infectious Disease

AAV particles of the current invention encoding an antibody are administered to a patient who has been diagnosed with an infectious disease, disorder or condition. The purpose of the treatment may be aimed to manage the disease, prevent or slow the progression of the disease, treat the symptoms associated with the disease and/or cure the disease.

The AAV particles may be administered through an intramuscular injection to the skeletal muscle. The administration may include one or more injections over a period of time. The level and distribution of AAV particles and antibody expression is monitored by standard diagnostic techniques known in the art. Such diagnostic techniques include e.g. (e.g. from blood, urine, or saliva), cerebrospinal fluid (CSF) testing, or any other testing useful for monitoring antibody levels in the body.

Additionally, the progression of the disease and the health of the patient is monitored by standard diagnostic techniques known in the art. Such techniques may include diagnostic imaging (e.g. X-ray, MRA scans, Ultrasound scans, PET scans. Nuclear scans, mammography), biopsy, laboratory tests (e.g. from blood, urine, or saliva), cerebrospinal fluid (CSF) testing, vital signs, clinical tests (cognitive, motor or reflex tests) and other relevant techniques. Treatment with the AAV particles may results in cure of the non-infectious disease, slowing down or stabilizing the progression of the disease, or have no effect on the progression of the disease. Additionally, the treatment may reduce severity of one or more symptoms associated with the disease, eliminate one or more symptoms associated with the disease or have no effect on the symptoms.

Example 8. Treatment of HIV or AIDS

AAV particles of the current invention encoding an antibody are administered to a patient who has been diagnosed with HIV or AIDS. The purpose of the treatment may be aimed to manage the disease, prevent or slow the progression of the disease, treat the symptoms associated with the disease and/or cure the disease.

The AAV particles may be administered through an intramuscular injection to the skeletal muscle. The administration may include one or more injections over a period of time. The level and distribution of AAV particles and antibody expression is monitored by standard diagnostic techniques known in the art. Such diagnostic techniques include e.g. (e.g. from blood, urine, or saliva), cerebrospinal fluid (CSF) testing, or any other testing useful for monitoring antibody levels in the body.

Additionally, the progression of the disease and the health of the patient is monitored by standard diagnostic techniques known in the art. Such techniques may include diagnostic imaging (e.g. X-ray, MRA scans, Ultrasound scans, PET scans. Nuclear scans, mammography), biopsy, laboratory tests (e.g. from blood, urine, or saliva), cerebrospinal fluid (CSF) testing, vital signs, clinical tests (cognitive, motor or reflex tests) and other relevant techniques. Treatment with the AAV particles may results in cure of the non-infectious disease, slowing down or stabilizing the progression of the disease, or have no effect on the progression of the disease. Additionally, the treatment may reduce severity of one or more symptoms associated with the disease, eliminate one or more symptoms associated with the disease or have no effect on the symptoms.

VIII. Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use: etc.) can be excluded from any one or more claims, for any reason, whether or not related to the existence of prior art.

SEQUENCE LISTING (9223 sequences)

SEQ ID NO: 1 - DNA, 2211 bp, Adeno-associated virus 1
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 2 - protein, 736 aa, Adeno-associated virus 1
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 3 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 4 - DNA, 3131 bp, Adeno-associated virus
gcggccgcgaattcgcccttggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcggaatttcaacatttgcttcacacacggggtcagagactgctcagagtgtttccccggcgtgtcagaatctcaaccggtcgtcagaaagaggacgtatcggaaactccgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcttacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacctttcaccacgtgactggcagcgactcatcaacaacaactggggattccgacccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgtccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagctagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctataagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattc

SEQ ID NO: 5 - DNA, 255 bp, Adeno-associated virus 10
ggtaattcctccggaaattggcattgcgattccacatggctgggcgacagagtcatcaccaccagcacccgaacctgggtcctgcccacctacaacaaccacatctacaagcaaatctccagcgagacaggagccaccaacgacaaccactacttcggctacagcaccccctgggggtattttgactttaacagattccactgccacttttcaccacgtgactggcagcgactcatcaacaacaactggggattc

SEQ ID NO: 6 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 7 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 8 - DNA, 258 bp, Adeno-associated virus 11
ggtaattcctccggaaattggcattgcgattccacatggctgggcgacagagtcatcaccaccagcacccgaacctgggccctgccaacctacaacaaccacctctacaaacaaatctccagcgcttcaacgggggccagcaacgacaaccactactttggctacagcaccccctgggggtattttgactttaacagattccactgccacttctcaccacgtgactggcagcgactcatcaacaacaactggggattc

SEQ ID NO: 9 - DNA, 255 bp, Adeno-associated virus 12
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattc

SEQ ID NO: 10 - DNA, 2208 bp, Adeno-associated virus 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 11 - protein, 735 aa, Adeno-associated virus 2 [sequence omitted]

SEQ ID NO: 12 - protein, 621 aa, Adeno-associated virus 2
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 13 - DNA, 4675 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 14 - DNA, 4679 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 15 - protein, 725 aa, Adeno-associated virus 5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPTTGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 16 - protein, 644 aa, Artificial Sequence
  Description of Artificial Sequence: Synthetic polypeptide
  MOD_RES (434)..(434): Any amino acid
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNXRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 17 - DNA, 1933 bp, Adeno-associated virus
caaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 18 - protein, 644 aa, Artificial Sequence
  Description of Artificial Sequence: Synthetic polypeptide
KAYDQQLKAGDNPYLRYNHADAEFQECLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMVAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFSPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 19 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 20 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSEPVPDPQPIGEPPAGPSGLGSGTMAAGGGAPMADNNEGADGVGNASGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLGRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 21 - DNA, 1933 bp, Adeno-associated virus; identical to SEQ ID NO: 19

SEQ ID NO: 22 - protein, 644 aa, Artificial Sequence; identical to SEQ ID NO: 20
  Description of Artificial Sequence: Synthetic polypeptide

SEQ ID NO: 23 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaatagcgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagcttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 24 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNSEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKLASFITQYSTGQVSVEIEWELQKENSKRWNPEIQYTSNFDKQTGVDFAVDSQGVYSEP

SEQ ID NO: 25 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggacccggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagattgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 26 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDPEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKIASFITQYSTGQVSVEIEWELQKENSKRWNPEIQYTSNFDKQTGVDFAVDSQGVYSEP

SEQ ID NO: 27 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSTTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKGNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 28 - DNA, 3121 bp, Adeno-associated virus
gaattcgcccttctacggctgcgtcaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcacgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgcgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcgatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacggcggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgactgagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagtaacgcgtctccacgacactgtcgcaaaataacaacagcaactttgtctggaccggtgccaccaagtatcatctgaatggcagagactctctggtagatcccggtgtcgctatggcaacccacaaggacgacgaagagcgattttttccgtccagcggagtcataatgtttgggaaacagggagctggaaaagacaacgtggactatagcagcgtcatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctacctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcaggaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 29 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDGVITTSTRTWALPTYNNHLYKQISNGTSGGSTNDNTYFGYSTPWGYFDFNRFHCHFSPRDWQRLINNNWGFRPKSLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNDNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 30 - DNA, 3121 bp, Adeno-associated virus
gaattcgcccttcgcgagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagcctcccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgtcttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgtcattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgaggctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactccgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 31 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 32 - protein, 736 aa, Adeno-associated virus 3
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 33 - DNA, 4726 bp, Adeno-associated virus 3
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 34 - protein, 737 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLNAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYEQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSDPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWDPEIQYTSNFEKQTGVDFAVDSQGVYSEPRPIGTRYLTRNL

SEQ ID NO: 35 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 36 - protein, 736 aa, Adeno-associated virus; identical to SEQ ID NO: 32

SEQ ID NO: 37 - protein, 736 aa, Adeno-associated virus 3A; identical to SEQ ID NO: 32

SEQ ID NO: 38 - protein, 624 aa, Adeno-associated virus 3A
MPGFYEIVLKVPSDLDERLPGISNSFVNWVAEKEWDVPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFEFELTRRLDHDFGKVTKQEVKDFFRWASDHVTDVAHEFYVRKGGAKKRPASNDADVSEPKRECTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 39 - protein, 736 aa, Adeno-associated virus 3B
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 40 - protein, 624 aa, Adeno-associated virus 3B
MPGFYEIVLKVPSDLDEHLPGISNSFVNWVAEKEWELPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFKFELTRRLDHDFGKVTKQEVKDFFRWASDHVTDVAHEFYVRKGGAKKRPASNDADVSEPKRQCTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 41 - DNA, 4722 bp, Adeno-associated virus 3B
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 42 - DNA, 1800 bp, Adeno-associated virus 4
  modified_base (342)..(342): a, t, c, or g
  misc_feature (342)..(342): n is a, c, g, or t
acggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 43 - DNA, 2208 bp, Adeno-associated virus 4
  modified_base (750)..(750): a, t, c, or g
  misc_feature (750)..(750): n is a, c, g, or t
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 44 - DNA, 1872 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataa

SEQ ID NO: 45 - DNA, 1611 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 46 - DNA, 1872 bp, Adeno-associated virus 4; identical to SEQ ID NO: 44

SEQ ID NO: 47 - DNA, 1617 bp, Adeno-associated virus 4
  modified_base (162)..(162): a, t, c, or g
  misc_feature (162)..(162): n is a, c, g, or t
atgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 48 - DNA, 939 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 49 - DNA, 1197 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaa

SEQ ID NO: 50 - DNA, 245 bp, Adeno-associated virus 4
ctccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagc

SEQ ID NO: 51 - protein, 313 aa, Adeno-associated virus 4
  MOD_RES (313)..(313): Any amino acid
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 52 - protein, 399 aa, Adeno-associated virus 4
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 53 - protein, 623 aa, Adeno-associated virus 4
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 54 - protein, 537 aa, Adeno-associated virus 4
  MOD_RES (537)..(537): Any amino acid
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 55 - protein, 623 aa, Adeno-associated virus 4; identical to SEQ ID NO: 53

SEQ ID NO: 56 - protein, 544 aa, Adeno-associated virus 4
MSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 57 - protein, 734 aa, Adeno-associated virus 4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 58 - protein, 598 aa, Adeno-associated virus 4
TAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 59 - DNA, 129 bp, Adeno-associated virus 4
ttggccactccctctatgcgcgctcgctcactcactcggccctgcggccagaggccggcagtctggagacctttggtgtccagggcagggccgagtgagtgagcgagcgcgcatagagggagtggccaa

SEQ ID NO: 60 - DNA, 125 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaa

SEQ ID NO: 61 - DNA, 4768 bp, Adeno-associated virus 4
  modified_base (3009)..(3009): a, t, c, or g
  misc_feature (3009)..(3009): n is a, c, g, or t
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacaccgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccatgatgatggagttggccactccctctatgcgcgctcgctcactcactcggccctggagaccaaaggtctccagactgccggcctctggccggcagggccgagtgagtgagcgagcgcgcatagagggagtggccaa

SEQ ID NO: 62 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgctgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgaccgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 63 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 64 - DNA, 2495 bp, Adeno-associated virus
gaattcgccctttctacggctgcgtcaactagaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaccagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaacagtacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 65 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNTSNFAWTGATKYHLNGRNSLTNPGVAMATNKDDEDQFFPINGVLVFGKTGAANKTTLENVLMTSEEEIKTTNPVATEQYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 66 - DNA, 2504 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 67 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSSRDWQRLINNNWGFRPKRLNFKLFNIQVKEVTQNEGTKTIANNLTSTIQVFTDSEYRLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKPASFITQYSTGQVSVEIEWELQKENSKRWNPEIQYTSNYYKSTNVDFAVNTEGTYSEPRPIGTRYLTRNL

SEQ ID NO: 68 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctagggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggctaattcgtttcagttgaactttggtctctgcgaagggcgaattc

SEQ ID NO: 69 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 70 - DNA, 3084 bp, Adeno-associated virus
gaattcgccctttctacggctgcatcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagaaaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggt

SEQ ID NO: 71 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 72 - DNA, 3123 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgctccagatgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggttaattcgtttcagttgaactttggtctctgcgaagggcgaattc

SEQ ID NO: 73 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 74 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcgccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagactggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcacggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 75 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRLVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFTVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 76 - DNA, 3117 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcgggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagagcaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 77 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVRVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQSNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 78 - DNA, 3121 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggcgccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcctttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggacttggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgccgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 79 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDLEYQLPYVLGSAHQGCLPPFPADVFMVPQYGYLTLNNGSQALGRSSFYCLEYFPSQMPRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 80 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagggttcttccgctgggcgcaggatcacgtgaccgaggtggcgcatgagttccacgtgcgagcccaagcgggcctgcccctcagtcgcggatccatcgacgtcagaccagaaagggtggagccaacaagagacccgcccccgatgacgcggatataagcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaattacatgttaatcaataaaccggttaattcgtttcagttgaactttggtctctgcgaagggcgaattc

SEQ ID NO: 81 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 82 - DNA, 2370 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagacgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtyggctcaggccaagaactggctacctggaccgtgttaccgtcagcaacgagtttccacgacactgtcgcaaaacaacaacagcaattttgctggaccggtgccacca

SEQ ID NO: 83 - protein, 738 aa, Artificial Sequence; identical to SEQ ID NO: 73
  Description of Artificial Sequence: Synthetic polypeptide

SEQ ID NO: 84 - DNA, 2205 bp, Adeno-associated virus
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 85 - protein, 734 aa, Adeno-associated virus; identical to SEQ ID NO: 57

SEQ ID NO: 86 - DNA, 3128 bp, Adeno-associated virus
gaattcgccctttctacggctgcgtcaactggaccaatgagaactttcccttcaacgattgcgtcgacaagatgttgatctggtgggaggagggcaagatgacggccaaggtcgtggagtccgccaaggccattctcggcggcagcaaagtgcgcgtggaccaaaagtgcaagccgtccgcccagatcgaccccacccccgtgatcgtcacctccaacaccaacatgtgcgccgtgattgacgggaacagcaccaccttcgagcaccagcagccgttgcgggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactgtaaatcccggtgtcgctatggcaacccacaaggacgacgaagagcgattttgcctggaccggtgccaccaagtatcatctgaatggcagagactctctgttttccgtccagcggagtcttaatgtttgggaaacagggagctggaaaagacaacgtggactatagcagcgttatgctaaccagtgaggaagaaattaaaaccaccaacccagtggccacggaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggacttcgctgttaacacagatggcacttattctgagcctcgccccattggcacccgttacctcacccgtaatctgtaattgctcgttaatcaataaaccggttgattcgtttcagttgaactttggtctctgcgaagggcgaattc

SEQ ID NO: 87 - protein, 738 aa, Artificial Sequence; identical to SEQ ID NO: 7
  Description of Artificial Sequence: Synthetic polypeptide

SEQ ID NO: 88 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggttgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagacccaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccattggcacccgttacctcacccgtaatctgtaattgcttgttaatcaataaaccggttgattcgtttcagttgaactttggtctctgcgaagggcgaattc

SEQ ID NO: 89 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRPNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 90 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 91 - DNA, 2172 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctt

SEQ ID NO: 92 - protein, 720 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYL

SEQ ID NO: 93 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 94 - DNA, 2175 bp, Adeno-associated virus 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 95 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 96 - protein, 736 aa, Adeno-associated virus 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 97 - protein, 623 aa, Adeno-associated virus 6
MPGFYEIVIKVPSDLDEHLPGISDSFVNWVAEKEWELPPDSDMDLNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAHDLTHVSQTQEQNKENLNPNSDAPVIRSKTSARYMELVGWLVDRGITSEKQWIQEDQASYISFNAASNSRSQIKAALDNAGKIMALTKSAPDYLVGPAPPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWAQDHVTEVAHEFYVRKGGANKRPAPDDADKSEPKRACPSVADPSTSDAEGAPVDFADRYQNKCSRHAGMLQMLFPCKTCERMNQNFNICFTHGTRDCSECFPGVSESQPVVRKRTYRKLCAIHHLLGRAPEIACSACDLVNVDLDDCVSEQ

SEQ ID NO: 98 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 99 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 100 - protein, 736 aa, Adeno-associated virus; identical to SEQ ID NO: 96

SEQ ID NO: 101 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 102 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 103 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 104 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 105 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 106 - protein, 737 aa, Adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 107 - protein, 623 aa, Artificial Sequence
  Description of Artificial Sequence: Synthetic polypeptide
MPGFYEIVIKVPSDLDEHLPGISDSFVNWVAEKEWELPPDSDMDLNLIEQAPLTVAEKLQRDFLVQWRRVSKAPEALFFVQFEKGESYFHLHVLVETTGVKSMVLGRFLSQIREKLVQTIYRGVEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPADIKTNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADISEPKRACPSVADPSTSDAEGAPVDFADRYQNKCSRHAGMIQMLFPCKTCERMNQNFNICFTHGVRDCLECFPGVSESQPVVRKKTYRKLCAIHHLLGRAPEIACSACDLVNVDLDDCVSEQ

SEQ ID NO: 108 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 109 - DNA, 2214 bp, Adeno-associated virus; identical to SEQ ID NO: 104

SEQ ID NO: 110 - protein, 737 aa, Adeno-associated virus; identical to SEQ ID NO: 106

SEQ ID NO: 111 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 112 - DNA, 2213 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgtaatacagaaggcgtgtactctgaaccccgccccattggcacccgttacctcacccgtaatctg

SEQ ID NO: 113 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 114 - protein, 738 aa, Adeno-associated virus 8; identical to SEQ ID NO: 105

SEQ ID NO: 115 - protein, 737 aa, Adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVIQKACTLNPAPLAPVTSPVI

SEQ ID NO: 116 - DNA, 2217 bp, Adeno-associated virus; identical to SEQ ID NO: 111

SEQ ID NO: 117 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcctgagcggacggcgatgagtcttccgggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 118 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLPERTAMSLPGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 119 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgagttttagtcgtgcggttctttgtgatggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 120 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLSFSRAVLCDGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 121 - DNA, 4385 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 122 - DNA, 4382 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgtagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcatcctcgggcatcggcaaatcaggccagcagcccgctaaaaagagactcaattttggtcagactggcgactcagagtcagtccccgacccacaacctctcggagaacctccagaagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaattgcctgttaatcaataaaccggttaattcgtttcagttgaactttggtctctgcg

SEQ ID NO: 123 - protein, 736 aa, Adeno-associated virus 9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 124 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPEAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 125 - protein, 623 aa, Artificial Sequence
  Description of Artificial Sequence: Synthetic polypeptide
MPGFYEIVIKVPSDLDEHLPGISDSFVNWVAEKEWELPPDSDMDRNLIEQAPLTVAEKLQRDFLVQWRRVSKAPEALFFVQFEKGESYFHLHVLVETTGVKSMVLGRFLSQIREKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPVDITQNRIYRILQLNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADKSEPKRACPSVADPSTSDAEGAPVDFADRYQNKCSRHAGMLQMLLPCKTCERMNQNFNICFTHGVRDCSECFPGVSESQPVVRKRTYRKLCAIHHLLGRAPEIACSACDLVNVDLDDCVSEQ

SEQ ID NO: 126 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 127 - protein, 736 aa, Adeno-associated virus; identical to SEQ ID NO: 123

SEQ ID NO: 128 - DNA, 2460 bp, Adeno-associated virus
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattcatggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 129 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaggcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccaggccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcgcggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccagtggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccacctgacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataagccgatttatgcgtttcagttgaactttggtctctgcgaagggcgaattcgtttaaacct

SEQ ID NO: 130 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPGPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSAVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPVASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 131 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcgggcaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagaaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcgaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacgataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcaggacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattcgcggccgcta

SEQ ID NO: 132 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGESGQQPAKKRLNFGQTGDTESVPDPQPIGEPPAAPSGVGSNTMASGGGAPMADDNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQDTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 133 - DNA, 3113 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgttcctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaataacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcaaccaagctgggcctagctccatggctcagcaggccaaaaactggctaccgggacccagctaccgacagcagcgaatgtctaagacggctaatgacaacaacaacagtgaatttgcttggactgcagccaccaaatattacccgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacgactaatcctgtggctacagaacaatacggacaggttgccaccaaccgtcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccggaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 134 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFNQAGPSSMAQQAKNWLPGPSYRQQRMSKTANDNNNSEFAWTAATKYYPNGRNSLVNPGPPMASHKDDEEKYFPMHGNLIFGKQGTGTTNVDIESVLITDEEEIRTTNPVATEQYGQVATNRQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 135 - DNA, 3122 bp, Adeno-associated virus
agcggccgcgaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaggtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcgcctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 136 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNRLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 137 - DNA, 3121 bp, Adeno-associated virus
gaattcgcccttcgcagagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagccccccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgccttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgttattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggcgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagtggagtctggagaacgctggggtgatggctctaccggtctcttctttccaggagccgtcttagcgccttcctcaaccagaccgagaggttcgagaacccgcttcttggcctggaagactgctcgtccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatctaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaagggcgaattc

SEQ ID NO: 138 - protein, 733 aa, Artificial Sequence
  Description of Artificial Sequence: Synthetic polypeptide
MAADGYLPDWLEDNLSEGIREWWDLKPGAPKLKANQQKQDDGRGLVLPGYKYLGPFHGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEGEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRRNPEVQFTSNYGNQSSMLWAPDTTGKYTEPRVIGSRYLTNHL

SEQ ID NO: 139 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 140 - DNA, 3127 bp, Adeno-associated virus
gcggccgcgaattcgcccttcgcagagaccaaagttcaactgaaacgaatcaaccggtttattgattaacatgcaattacagattacgggtgaggtaacgagtgccaatagggcgaggctcagagtaaacaccctggctgtcaacggcaaagtccacaccagtctgcttttcaaagttggaggtgtactgaatctccgggtcccagcgcttgctgttttccttctgcagctcccactcgatttccacgctgacttgtccggtgctgtactgtgtgatgaacgaagcaaacttggcaggagtaaacacctccggaggattagcgggaacgggagtgttcttgatcaggatctgaggaggcggatgtttaagtccaaagccgcccatcaaaggagacgggtgaaagttgccatccgtgtgaggaatcttggcccagatgggaccctgcaggtacacgtcccggttctgccagaccatgccaggtaaggctccctggttgttgacaacttgtgtctgggctgcagtattagccgcttgtaagttgctgctgactatcccgtattcttccgtggctacaggattagtaggacgaatttcttcttcatttgtcattaacacattttccaatgtagttttgttagttgctccagtttttccaaaaatcaggactccgctggatgggaaaaagcggtcctcgtcgtccttgtgagttgccatggcgacgccgggattaaccaacgagtttctgccgttcaggtgatatttggtggcaccagtccaagcaaagttgctgttgttgttttgatccagcgttttggagaccctttgttgccggaagcagggtccaggtaaccaattcttggcttgttcggccatagttgaaggcccgccctggtaaaactgcagttcccgattgccagctgtgcctcctgggtcactctgtgttctggccaggtagtacaagtactggtcgatgaggggattcatcagccggtccaggctctggctgtgtgcgtagctgctgtggaaaggcacgtcctcgaagctgtagctgaactcaaagttgttgcccgttctcagcatctgagaggggaagtactccaggcagtagaaggaggaacgtcccacagactgactgccattgttgagagtcaggtagccgtactgaggaatcatgaagacgtccgccgggaacggaggcaggcagccctggtgcgcagagccgaggacgtacggcagctggtattccgagtccgagaatacctgaatcgtgctggtaaggttattagcgatggtcgtaacgccgtcattcgtcgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtaggtgttgtcgttggtactacctgcagtttcactggagatttgctcgtagaggtggttgttgtaggtgggcagggcccaggttcgggtgctggtggtaatgactctgtcgcccagccatgtggaatcgcaatgccaatttcctgaggcattacccactccgtcggcaccttcgttattgtctgccattggtgcgccaccgcctgcagccactgtaccagatcccacactagagggcgctgctggaggttctccgagaggttgagggtcggggactgactctgagtcgccagtctgaccgaaattgagtctctttctggcgggctgctggcccttcttgccgatgcccgtggaggagtcgggggaacgctgaggtgacggctctaccggtctcttctttgcaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacgggttgtcacccgcattgagctgctggtcgtaggccttgtcgtgctcgagggccgctgcgtccgccgcgttgacgggctcccccttgtcgagtccgttgaagggtccgaggtacttgtagccaggaagcaccagaccccggccgttgtcctgcttttgctggttggctttgggtttcggggctccaggtttcaggtcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggtttagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtaatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcgatcacggcgcacatgttggtgttggagatgacgatcgcgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 141 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLRPFNGLDKGEPVNEADAAALEHDKAYDKQLEQGDNPYLKYNHADAEFQERLQEDTSFGGNLGRAVFQAKKRVLEPLGLVEEVAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFSYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYVHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVCLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 142 - DNA, 3106 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggcacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtctaggctctggctgtgcacatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagctgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgacttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtctgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcactctctcgcatgtcttgcagggaaacagcatctgaagcatgcccgcgtgacgagaacatttgttttggtacctgtcggcaaagtccaccggagctccttccgcgtctgacgtcgatggattcgcgactgaggggcaggcccgcttgggctcgcttttatccgcgtcatcgggggcgggtctcttgttggccccaccctttctgacgtagaacccatgcgccacctcggtcacgtgatcctgcgcccagcggaagaaccttttgacttcctgctttgtcaccttgccaaagttatgctccagacggcgggtgggttcaaatttgaacatccggtcctgcaacggctgctggtgctcgaaggtggcgctgttcccgtcaatcacggcgcacatgttggtgttggaggtgacggtcacgggggtggggtcgatctgggcggacgacttgcacttttggtccacgcgcaccttgctgccgccgagaatggccttggcggactccacgaccttggccgtcatcttgccctcctcccaccagatcaccatcttgtcggcgcaatcgttgaagggaaagttctcattggtccagttgacgcagccgtagaaagggcgaattc

SEQ ID NO: 143 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTASGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFCCLEYFPSQMLRTGNNFEFSYTFEEVPFHSSYAHSQSLDRLMNPLIDQYLYYLARTQSTTGSTRELQFHQAGPNTVAEQSKNWLPGPCYRQQRLSKNIDSNNNSNFAWTGATKYHLNGRNSLTNPGVAMATNKDDEDQFLPINGVLVFGKTGAANKTTLENVLMTSEEEIKTTNPVATEEYGVVSSNLQSSTAGPRTQTVNSQGALPGMVWQNRDVYLQGPIWAEIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 144 - DNA, 3102 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaatttcggcccagatgggaccctgcaggtacacgtcccggttctgccagaccatgccgggcagagccccctggctgttgacagtctgtgtccggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaggaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccacggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagcagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccggaagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaagcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgaagggcgaattc

SEQ ID NO: 145 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 146 - protein, 728 aa, Artificial Sequence
  Description of Artificial Sequence: Synthetic polypeptide
MAADGYLPDWLEGNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 147 - DNA, 3106 bp, Adeno-associated virus
gcggccgcgaattcgcccttcgcagagaccaaagttcaactgaaacgaatcagccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttatcgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggcggctggccgttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacctgtagccaggaagcaccagaccccggccgtcgtcctgcttttgctggttggctttgggtttcggggctccaggtttcaagtcccaccactcgcgaatgccctcagagaggttgccctcgagccaatctggaagataaccatcggcagccatacctggtttaagtcatttattgctcagaaacacagtcatccaggtccacgttggccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcaggggaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatacgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcctgccctcctcccaccagatcaccatcttgtcgacgcaatcgttgaagggaaagttctcattggtccagttgacgcagccgtagaaagggcgaattc

SEQ ID NO: 148 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSMGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEGQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPGVFTPALFASFITQYSTGQVSVEIEWELQKENSKRWNPEIQYTSNYAKSNNVEFAVNNEGVYTEPRPIGTRYLTRNL

SEQ ID NO: 149 - DNA, 3098 bp, Adeno-associated virus
gaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaactaggcaggagtaaacacccctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggccctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagtagaaggaggaacgtcccatagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcagcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggcctcttgttggctccaccctttctgacgtagaactcatgcgccacctcggtcacgtgatcctgcgcccagcggaagaactctttgacttcctgctttgtcaccttgccaaagtcctgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 150 - DNA, 2187 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 151 - protein, 728 aa, Adeno-associated virus; identical to SEQ ID NO: 146

SEQ ID NO: 152 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 153 - protein, 728 aa, Adeno-associated virus; identical to SEQ ID NO: 145

SEQ ID NO: 154 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 155 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 156 - DNA, 2215 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagtttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 157 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 158 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 159 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 160 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 161 - DNA, 3075 bp, Adeno-associated virus
tgagaactttcctttcaacgattgcgtcggacaagatggtgatctggtgggaggaggggaagatgaccgccaaggtcgtggagtcggccaaagccattcttggaggaagcaaggtgcgtgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcaacgtcagacgcggaagcttcgatcaactacgcggacaggtaccaaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaa

SEQ ID NO: 162 - DNA, 3142 bp, Adeno-associated virus
aaaacgacgggccagtgattgtaatacgactcactatagggcgaaattgaaattagcggccgcgaattcgcctttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagacttgttgtagttggaagtgtactgaatttcgggattccagcgtttgctgttctccttctgcagctcccactcgatctccacgctgacctgtcccgtggaatactgtgtgatgaaagaagcaaacttggcagaactgaagtttgtgggaggattggctggaacgggagtgtttttgatcatgatctgaggaggcgggtgtttgagtccaaaacctcccatcagtggagaaggatgaaagtgtccatcggtgtgaggaatcttggcccaaatgggtccctgcaggtacacgtctcgatcctgccacaccataccaggtaacgctccttggtgattgacagttccagtagttggaccagtgtttgagttttgcaaattatttgacacagtcccgtactgctccgtagccacgggattggtggccctgatttcttcttcatctgtaatcatgacattttccaaatccgcgtcgttggcatttgttccttgtttaccaaatatcagggttccatgcatggggaaaaacttttcttcgtcatccttgtgactggccatagctggtcctggattaaccaacgagtcccggccatttagatgatactttgtagctgcagtccagggaaagttgctgttgttgttgtcgtttgcctgttttgacagacgctgctgtctgtagcaaggtccaggcagccagtttttagcttgaagagacatgttggttggtccagcttggctaaacagtagccgagactgctgaagagttccactatttgtttgtgtcttgttcagataatacaggtactggtcgatcagaggattcatcagccgatccagactctggctgtgagcgtagctgctgtggaaaggcacgtcttcaaaagtgtagctgaactgaaagttgtttccagtacgcagcatctgagaaggaaagtactccaggcagtaaaaggaagagcgtcctaccgcctgactcccgttgttcagggtgaggtatccatactgtgggaccatgaagacgtccgctggaaacggcgggaggcatccttgatgcgccgagcccaggacgtacgggagctggtactccgagtcagtaaacacctgaaccgtgctggtaaggttattggcaatcgtcgtcgtaccgtcattctgcgtgacctctttgacttgaatattaaagagcttgaagttgagtcttttgggccggaatccccggttgttgttgacgagtctttgccagtcacgtggtgaaaagtggcagtggaatctgttgaagtcaaaatacccccagggggtgctgtagccaaagtagtggttgtcgttgctggctcctgattggctggagatttgcttgtagaggtggttgttgtatgtgggcagggcccaggttcgggtgctggtggtgatgactctgtcgcccagccattgggaatcgcaatgccaatttcctgaggaattacccactccatcggcaccctcgttattgtctgccattggtgcgccactgcctgtagccattgtagtagatcccagaccagagggggctgctggtggctgtccgagaggctgggggtcaggtacggagtctgcgtctccagtctgaccaaaatttaatctttttcttgcaggctgctggcccgcttttccggttcccgaggaggagtctggctccacaggagagtgctctaccggcctcttttttcccggagccgtcttaacaggctcctcaaccaggcccagaggttcaagaaccctctttttcgcctggaagactgctcgtccgaggttgcccccaaaagacgtatcttctttaaggcgctcctgaaactctgcgtcggcgtggttgtacttgaggtacgggttgtctccgctgtcgagctgccggtcgtaggccttgtcgtgctcgagggccgcggcgtctgcctcgttgaccggctcccccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttagctccaccctttttgacgtagaattcatgctccacctcaaccacgtgatcctttgcccaccggaaaaagtctttcacttcctgcttggtgacctttccaaagtcatgatccagacggcgggtaagttcaaatttgaacatccggtcttgcaacggctgctggtgctcgaaggtcgttgagttcccgtcaatcacggcgcacatgttggtgttggaggtgacgatcacgggagtcgggtctatctgggccgaggacttgcatttctggtccacacgcaccttgcttcctccaagaatggctttggccgactccacgaccttggcggtcatcttcccctcctcccaccagatcaccatcttgtcgacgcaatggtaaaaggaaagttctcattgg

SEQ ID NO: 163 - protein, 735 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQDKALLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 164 - protein, 740 aa, Adeno-associated virus 2
MAADGYLPDWLEDTLSEGIRQWWKLKPGPPPPKPAERHKDDSRGLVLPGYKYLGPFNGLDKGEPVNAADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAAA

SEQ ID NO: 165 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATMYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 166 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSEAKFASFITQYSTGQVSVEIEWELQKENSKRWNPEIQYTSNYNKSVNVDFTVDTNGVYSEPRPIGTRYLTRN

SEQ ID NO: 167 - protein, 739 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAA

SEQ ID NO: 168 - protein, 725 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRP

SEQ ID NO: 169 - protein, 707 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSCIYQPPERQQTSSYRRCQHTRRSSRHGLAGQRCVPSGAHLGKDSTHGRTFSPLSPHGWIRTTPSSTDSHQEHPGTCESFDHLQCGKVCFLHHTVLHGTGQRGDRVRAAEGKQQTLESRNSVHFQLQQVC

SEQ ID NO: 170 - protein, 739 aa, Adeno-associated virus 2; identical to SEQ ID NO: 167

SEQ ID NO: 171 - protein, 737 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHHPPQILIKNTPVPANPSTTFSAAKFASFITQYSTGQVSVEIEWELQKENSKRWNPEIQYTSNYNKSVNVDFTVDTNGVYSEPRPIGTRYLTRNLL

SEQ ID NO: 172 - protein, 741 aa, Adeno-associated virus 2
MAADGYLPDWLEDTLSEGIREWWALKPGAPKPKANQQKQDDGRGLVLPGYKYLGPFNGLDKGEPVNEADAAALEHDKAYDQQLQAGDNPYLRYNHADAEFQERLQEDTSFGGNLGRAVFQAKKRVLEPLGLVEEPVKTAPGKKRPVEHSPVEPDSSSGTGKSGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNLANHNNTTNARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYL

SEQ ID NO: 173 - protein, 730 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTR

SEQ ID NO: 174 - protein, 735 aa, Adeno-associated virus 2
  MOD_RES (239)..(239): Any amino acid
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 175 - protein, 733 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFLAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLT

SEQ ID NO: 176 - protein, 734 aa, Adeno-associated virus 2
MAADGYLPDWLEDTLSEGIRQWWKLKPGPPPPKPAERHKDDSRGLVLPGCKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFSDSEYQLPYVLGSAHQGCLPPFPADVFMIPQYGYLTLNNGSQAVGRSSFYCLEYFPSQMLRTGNNFTFNYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 177 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALSTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 178 - protein, 738 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLRP

SEQ ID NO: 179 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 180 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 181 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 182 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 183 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 184 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 185 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 186 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 187 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 188 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 189 - DNA, 3161 bp, Adeno-associated virus
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 190 - DNA, 3162 bp, Adeno-associated virus
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 191 - DNA, 3164 bp, Adeno-associated virus
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 192 - DNA, 3163 bp, Adeno-associated virus
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 193 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 194 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 195 - DNA, 3161 bp, Adeno-associated virus
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 196 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 197 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 198 - protein, 738 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 199 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 200 - DNA, 3167 bp, Adeno-associated virus
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 201 - DNA, 3161 bp, Adeno-associated virus
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 202 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 203 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 204 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 205 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 206 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 207 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 208 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 209 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 210 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 211 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 212 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 213 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 214 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 215 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 216 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 217 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 218 - DNA, 2208 bp, Adeno-associated virus; identical to SEQ ID NO: 212

SEQ ID NO: 219 - protein, 735 aa, Adeno-associated virus; identical to SEQ ID NO: 213

SEQ ID NO: 220 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 221 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 222 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 223 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 224 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 225 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 226 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 227 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 228 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 229 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 230 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 231 - protein, 735 aa, Adeno-associated virus; identical to SEQ ID NO: 230

SEQ ID NO: 232 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 233 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 234 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 235 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 236 - DNA, 2211 bp, Adeno-associated virus; identical to SEQ ID NO: 126

SEQ ID NO: 237 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 238 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 239 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 240 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 241 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 242 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 243 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 244 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 245 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 246 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 247 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 248 - protein, 738 aa, Adeno-associated virus; identical to SEQ ID NO: 90

SEQ ID NO: 249 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 250 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 251 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 252 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 253 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 254 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 255 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 256 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 257 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 258 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 259 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 260 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 261 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 262 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 263 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 264 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 265 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 266 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 267 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 268 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 269 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 270 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 271 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 272 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 273 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 274 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 275 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 276 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 277 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 278 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 279 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 280 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 281 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGANSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 282 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 283 - protein, 735 aa, Adeno-associated virus
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 284 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 285 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 286 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 287 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 288 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 289 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 290 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 291 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 292 - DNA, 3160 bp, Adeno-associated virus
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 293 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 294 - DNA, 3157 bp, Adeno-associated virus
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 295 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 296 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 297 - DNA, 3159 bp, Adeno-associated virus
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 298 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 299 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 300 - DNA, 3156 bp, Adeno-associated virus
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 301 - protein, 734 aa, Adeno-associated virus
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 302 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 303 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 304 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 305 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 306 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 307 - DNA, 3158 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 308 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 309 - DNA, 3159 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 310 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 311 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 312 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 313 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 314 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 315 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 316 - protein, 738 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 317 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 318 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 319 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 320 - DNA, 2211 bp, Adeno-associated virus; identical to SEQ ID NO: 1

SEQ ID NO: 321 - DNA, 2208 bp, Adeno-associated virus
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 322 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 323 - protein, 735 aa, Adeno-associated virus
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 324 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 325 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 326 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 327 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 328 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 329 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 330 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 331 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 332 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 333 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 334 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcccctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 335 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 336 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatgactgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 337 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 338 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgccttttcacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 339 - protein, 737 aa, Artificial Sequence; identical to SEQ ID NO: 327
  Description of Artificial Sequence: Synthetic polypeptide

SEQ ID NO: 340 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 341 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 342 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttccgggttacaaatacctcggacccggtaacggactcgacaaaggagagccggtcaacgaggcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcccggaaagaaacgtccggtagagcagtcgccacaagagccagactcctctacgggcatcggcaagaaaggccaacagcccgccagaaaaagactcaatttcggtcagactggcgactcagagtcagttccagaccctcaacctctcggagaacctccagcagcgccctctggtgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaacacctacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 343 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPGNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPAAPSGVGPTTMASGGGAPMADNNEGADGVGNASGNWHCDSTWLGDRVITTSTRTWALPTYNNHLYKQISSASTGASNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 344 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 345 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPADPPTTFNQSKLNSFITQYSTGQVSVEIEWELQKENSKRWNPEVQYTSNYAKSANVDFTVDNNGLYTEPRPIGTRYLTRPL

SEQ ID NO: 346 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagtgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcaccgacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 347 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKWVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 348 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctcggcgcaccagggctgcctccctccgttcccggcggacgtcttcatggtgccacagtatggatacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggacttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 349 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMVPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGDLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 350 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaactgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttaccaaacctctgtaa

SEQ ID NO: 351 - protein, 734 aa, Artificial Sequence
  Description of Artificial Sequence: Synthetic polypeptide
MAADGYLPDWLEDNLSEGIREWWALKPGVPQPKANQQHQDNCRGLVLPGYKYLGPGNGLDKGEPVNEADAAALEHDKAYDQQLKAGDNPYLKYNHADAEFQERLKEDTSFGGNLGRAVFQTKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTKPL

SEQ ID NO: 352 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 353 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 354 - DNA, 2214 bp, Artificial Sequence; identical to SEQ ID NO: 326
  Description of Artificial Sequence: Synthetic polynucleotide

SEQ ID NO: 355 - protein, 737 aa, Artificial Sequence; identical to SEQ ID NO: 327
  Description of Artificial Sequence: Synthetic polypeptide

SEQ ID NO: 356 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaaacacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 357 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTSVDFAVNTEGVYSEPRPIGTRYLTRNL

SEQ ID NO: 358 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccctctcccctcatgggtggattcggacttaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 359 - protein, 738 aa, Artificial Sequence; identical to SEQ ID NO: 105
  Description of Artificial Sequence: Synthetic polypeptide

SEQ ID NO: 360 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaggtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 361 - protein, 736 aa, Artificial Sequence; identical to SEQ ID NO: 331
  Description of Artificial Sequence: Synthetic polypeptide

SEQ ID NO: 362 - DNA, 2211 bp, Artificial Sequence; identical to SEQ ID NO: 330
  Description of Artificial Sequence: Synthetic polynucleotide

SEQ ID NO: 363 - protein, 736 aa, Artificial Sequence; identical to SEQ ID NO: 331
  Description of Artificial Sequence: Synthetic polypeptide

SEQ ID NO: 364 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 365 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 366 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcaacggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 367 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADATALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 368 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaaacaaatttccagccaatcaggagcctcgaacgacaatcactactttggctacagcaccccttgggggtattttgatttcaacagattccactgccacttttcaccacgtgactggcagcgactcatcaacaacaattggggattccggcccaagagactcagcttcaagctcttcaacatccaggtcaaggaggtcacgcagaatgaaggcaccaagaccatcgccaataaccttaccagcacggttcaagtgtttacggactcggagtatcagctcccgtacgtgctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctgattgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggactatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccgtctccgctgatgggcggctttggcctgaaacatcctccgcctcagatcctgatcaagaacacgcctgtacctgcggatcctccgaccaccttcaaccagtcaaagctgaactctttcatcactcagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 369 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDYEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 370 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatttgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacccgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 371 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDADSVPDPQPLGQPPAAPSGLGTNTMATGSGAPMADNNEGADGVGNSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTFADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 372 - DNA, 2217 bp, Artificial Sequence
  Description of Artificial Sequence: Synthetic polynucleotide
atggctgccgatggttatcttccagattggctcgaggacactctctctgaaggaataagacagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 373 - protein, 738 aa, Artificial Sequence
  Description of Artificial Sequence: Synthetic polypeptide
MAADGYLPDWLEDTLSEGIRQWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 374 - DNA, 2208 bp, Artificial Sequence; identical to SEQ ID NO: 10
  Description of Artificial Sequence: Synthetic polynucleotide

SEQ ID NO: 375 - protein, 735 aa, Artificial Sequence [sequence omitted]

SEQ ID NO: 376 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgccgcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcagctaaaacggctcctggaaagaagaggcctgtagagcagtctcctcaggaaccggactcctccgcgggtattggcaaatcgggtgcacagcccgccaaaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacagcaaccatctctacaagcaaatctccagccaatcaggagcttcaaacgacaacgactactttggctacagcaccccttgggggtattttgatttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgaggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 377 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPTSLGSNTMASGGGAPMADNNEGADGVGNASGNWHCDSTWLGDRVITTSTRTWALPTYSNHLYKQISSQSGASNDNDYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSEDNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 378 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagttccaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcttcaaacgacaaccactactttggctacagcaccccttgggggtattttgactttaacagattccactgccacttttcaccacgtgactggcagcgactcattaacaacaactggggattccggcccaagaaactcaacttcaagctctttaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtattacttgtctcggactcaaacaacaggaggcacgacaaatacgcagactctgggcttcagccaaggtgggcctaatacaatggccaatcaggcaaagaactggctgcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggttatgattacagacgaagaggaaatcaggacaaccaatcccgtggctacggagcagtatggttctgtatctaccaacctccagagaggcaacagacaagcagctaccgcagatgtcaacacacagggcgttcttccaggcatggtctggcaggacagagatgtgtaccttcagggtcccatttgggccaaaattcctcacacagatggacactttcacccgtcccctcttatgggcggctttggactcaagaacccgcctcctcagatcctcatcaaaaacacgcctgttcctgcgaatcctccggcagagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacactaatggcgtgtattcagagcctcgccccattggcaccagatacctcacccgtaatctgtaa

SEQ ID NO: 379 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKKLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDTNGVYSEPRPIGTRYLTRNL

SEQ ID NO: 380 - DNA, 2214 bp, Artificial Sequence; identical to SEQ ID NO: 370
  Description of Artificial Sequence: Synthetic polynucleotide

SEQ ID NO: 381 - protein, 737 aa, Artificial Sequence; identical to SEQ ID NO: 371
  Description of Artificial Sequence: Synthetic polypeptide

SEQ ID NO: 382 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 383 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 384 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 385 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 386 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 387 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 388 - DNA, 4404 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaaatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 389 - protein, 738 aa, Adeno-associated virus; identical to SEQ ID NO: 7

SEQ ID NO: 390 - DNA, 3129 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctgggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 391 - protein, 738 aa, Artificial Sequence; identical to SEQ ID NO: 7
  Description of Artificial Sequence: Synthetic polypeptide

SEQ ID NO: 392 - protein, 733 aa, Artificial Sequence
  Description of Artificial Sequence: Synthetic polypeptide
MAADGYLPDWLEDNLSEGIREWWDLRPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 393 - DNA, 2501 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttgattcgtttcagttgaactttggtctcaagggcgaattc

SEQ ID NO: 394 - DNA, 2187 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 395 - protein, 728 aa, Adeno-associated virus; identical to SEQ ID NO: 63

SEQ ID NO: 396 - protein, 728 aa, Adeno-associated virus; identical to SEQ ID NO: 155

SEQ ID NO: 397 - protein, 728 aa, Adeno-associated virus; identical to SEQ ID NO: 155

SEQ ID NO: 398 - protein, 733 aa, Artificial Sequence
  Description of Artificial Sequence: Synthetic polypeptide
MAADGHLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNSWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 399 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaagacatgcgagagaatgaatcagaatttcagcatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatagctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 400 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFRAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNRGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMAWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 401 - DNA, 3106 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggcgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcccgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 402 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 403 - DNA, 3197 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattcgtttaaacctgcaggactagtccctttagtgagggttaattctgagcttggcgtaatcatgggtcatag

SEQ ID NO: 404 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 405 - DNA, 3276 bp, Adeno-associated virus
gaattcgcccttcgcagagaccaaagttcaactgaaacgaattaaccggtttattgattaacaggcaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgtccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctatgcgcatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgtccgtcgtgacctccttgacctggatgttgaacaacttgaaccgcagctttctgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctgtcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacacttgttttggtacctgtcggcaaagtccaccggagctccttccgcgtctgacgtcgatggatgcaaaatgtcgcaaaagcactcacgtgacagctaatacaggaccactcccctatgacgtgatttacgtcagcgctatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcctgcaacggctgctggtgctcgaaggtggtgctgttcccgtcaatcacggcgcacatgttggtgttggaagtgacgatcacgggggtgggatcgatctgggcggaagacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 406 - protein, 738 aa, Adeno-associated virus; identical to SEQ ID NO: 71

SEQ ID NO: 407 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 408 - protein, 738 aa, Adeno-associated virus; identical to SEQ ID NO: 69

SEQ ID NO: 409 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGRKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 410 - DNA, 2489 bp, Adeno-associated virus
gaattcgccctttctacggctgcgtcaactggaccaatgagaactttcccttcaacgattgcgtcgacaagatggtgatctggtgggaggagggcaagatgacggccaaggtcgtgaagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaggaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgccaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtcaagggcgaattc

SEQ ID NO: 411 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRRQRLSKDIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 412 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccggagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaattacttgttaatcaataaaccggttgattcgtttcagttgaactttggtctctgcgaagggcgaattc

SEQ ID NO: 413 - protein, 685 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLTNPLIDQYLYYLARTQSTTGSTRGLQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKYTSNYYKSTNVDFAVNTEGTYSEPRPIGTRYLTRNL

SEQ ID NO: 414 - DNA, 2969 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 415 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 416 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaattgcctgttaatcaataaaccggttgattcgtttcagttgaactttggtctctgcgaagggcgaattc

SEQ ID NO: 417 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 418 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcgcgggaccagagactgttcagaatgtttcccgggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 419 - protein, 738 aa, Adeno-associated virus; identical to SEQ ID NO: 407

SEQ ID NO: 420 - DNA, 1933 bp, Adeno-associated virus
  modified_base (1302)..(1302): a, t, c, or g
  misc_feature (1302)..(1302): n is a, c, g, or t
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 421 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLSPFPNDVFMVPQYGYCGIVTGENQNQTDRNAFYCLEYFPSQMLRTGNNFEMAYNFGKVPFHSMYAYSQSPDRLMNPLLDQYLWHLQSTTSGETLNQGNAATTFGKIRSGDFAFYRKNWLPGPCVKQQRLSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 422 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcccgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 423 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 424 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 425 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYEYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFETAYNFEKVPFHSMYAHSQSLDGLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPAYPATTFTAARVDSFITQYSTGQVAVQIEWEIEKERSKRWNPEVQFTSNCGNQSSMLWAPDTTGKYTEPRVIGSRYLTNHL

SEQ ID NO: 426 - DNA, 3105 bp, Adeno-associated virus
gaattcgcccttcgcagagaccaaagttcaactgaaacgaatcacacggtttattgattaactaggcagttacaaatgattagtcaaataacgagagccaataacccgcggctctgtatacttcccagttgtatcgggagcccacaacatagaagactggttcccacagtttgaagtaaactgcacttcaggattccagcgtttggagcgttccttttcgatttcccattcaatctgaacagcgacctggccggtgctgtattgtgtgatgaaagagtccactctggctgcagtgaaggttgtcgcaggataggcaggtacgggggtgtttttgataaatatctggggaggcggatgtttcagtccaaaaccgccaattagcggtgaaggatgaaaatgtccgtccgcgtgtgggatcttggcccaaattggcccttggtagtaaatgtctctgttttgccacaccatgccaggaagcactcccatagcagtcacgttgccggttatgggagcagttgtagcattctgattattgtcagcaatctgaccaaacatgtccgtgtctcttgggttggtggcagcaatttcttcttctgatgtaaacaacagattgtttgctgaggttgttgtgtttccggtgactgatggtccagggaagatgagctgggcgttgctgaagtccccatctgaaggtccagctgttgccattggaggtccaggcgctatgttgctccagcggttgtttaaggtatagtgggtgtcatactttaacagagcgttgcccccgctggcaggaatcttgtaattttgactggcagtttttgagaatctctgctgtttaacacaaggcccaggcagccagttctttctgtaaaaggcaaagtctccactcctgatttttccaaatgtggttgctgcattgccttgattcagagtctctccagaggtggtcgactgtaagtgccacaggtactggtccaggaggggattcatcagtccgtccaggctctggctgtgagcatacattgagtggaacggcaccttctcaaagttgtaagccgtttcaaagttattgccagttctcagcatttgtgaaggaaaatactccaggcagtagaaagcatttctgtccgtctggttctgattttcgccagtcacaatgccacagtagccatattgaggcaccatgaagacgtcattggggaaaggaggcagacttccctcttgtccagcgtccatcacgtacgggagctcatacgacgagtccgcaaatatctgaaccgtgctggtaaggttattagcgaccgtagtctcgccgttcgacgttgtgacctccttaacttggatattgaagattttaacgcgcatggcttttggtcgtagtccccagttgttgttgatgagtctttgccagtcacgtggtgagaagtgacagtggaatctgttaaagtcaaagtatccccagggggtggagaatccgttgtaggtgttgctgtttgatgttgttccgagccgcaggtacaagtggttgttgtaggtgggcaagacccaggttctggtcgaggttgttgtgaccttgccctcagaccaggtggaatcgcaatgccaatcacccgaggcattacccactccatcggaaccttgtcccgcatcgacagcatttccgcccggtgctgcacgcatttcaatgtctgaagacatggcgctggtatctgatccttcagggggtccgtctccggctccagtgtcctcttcaaagttgagtctctttttggctggttgtttgccttttttgccgattcctgaggaggagtcgggctcttgtggtgactctaacggtctcttctttccaggagccgtcttagcaccttcttcaaccaggcccagaggttcgagtaccctcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtactcgtagccaggaagcaccagaccccggccgtcgtcctgcttctgctggttggccttgggcttgggggctccaggtttcaggtcccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacacgcaatctcgggtgcccgccccagcagatgatgaatcgcgcacagtttctgatacgtcttttttctgacgacgggttgagattctgacgcgccggggaagcactctgagcagtctctgaccccgtgcgtgaagcagacgttgaaattctgattcattctctcgcatgtcttgcagggaaacagcatctgaagcatgcccgcgtgacgagaacatttgttttggtacctgtccgcaaggtccaccggtgcttccgcgtctgacgtcgatggctccgcaactgaggggcaggcccgcttgggctcgcttatatccgcgtcactgggggcgggtcttttggtggctccgccctttctgacgtagaactcatgcgccacctcagtcacgtgatcctgagcccagcggaagaactctttgacttcctgcttggtcaccttgccaaagtcgtgctccagacggcgggtgagctcgaacttgaacatgcggtcctgcagcggctgctggtgctcgaaggtggtgctgttcccgtcgatcacggcgcacatgttggtgttggaggtgacgatcacgggcgtggggtcgatctgggccgatgacttgcacttttggtccacgcgcaccttgcttccgcccagaatggccttggcggactccacgaccttggcggtcatcttgccctcctcccaccagatcaccatcttgtcgacgcaatcgttgaagggaaagttctcattggtccagttgacgcagcaagggcgaattc

SEQ ID NO: 427 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 428 - DNA, 3094 bp, Adeno-associated virus
gaattcgcccttgctgcgtcaactggaccaagagaactttcccttcaacgattgcgtcgacaagatggtgatctggtgggaggagggcaagatgacggccaaggtcgtggagtccgccaaagccattctgggcggaagcaaggtgcgcgtcgaccaaaagtgcaagtcctcggcccagatcgatcccacccccgtgatcgtcacctccaacaccaacatgtgcgccgtgatcgacgggaacagcaccaccttcgagcaccagcagccgttgcaggaccggatgttcaaatttgaactcacccgccgtctggaacacgactttggcaaggtgaccaagcaggaagtcaaagagttcttccgctgggctagtgatcacgtgactgaggtgacgcatgagttctacgtcagaaagggcggagccagcaaaagacccgcccccgatgacgcggatataagcgagcccaagcgggcctgtccctcagtcacggacccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacgcacggggtcagagactgtttagaatgtttccccggcgtgtcagaatctcaaccggtcgtcagaaaaaagacgtatcggaagctgtgtgcgattcatcatctgctggggcgggcacccgagattgcttgctcggcctgcgacctggtcaacgtggacctggacgactgtgtttctgagcaataaatgacttaaaccgggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaattgcttgttaatcaataaaccggttgattcgtttcagttgaactttggtctctgcgaagggcgaattc

SEQ ID NO: 429 - protein, 1458 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNLMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIGSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLLNIQVKEVTTNDGVTTIANNLTSTVQVFSDSEYQLPYVLGSAHQGCLPPFPADVFMIPQYGYLTLDNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 430 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgtttgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgtccagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaggagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccattggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagcctatgggtctcttctttccaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcacctgaagcatgcccgcgtgacgagaacatttgttttggtacctgtcggcaaagtccaccggagctccttccgcgtctgacgtcgatgggtccgtgactgagggacgggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggttgctggtgctcgaaggtggtgctgttcccgtcgatcacggcgcacatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 431 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgttcgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgttcagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccgttggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagtctatgggtctcttctttccaggagccgtcttagcgccttcctcaaccagaccgagaggttcgagaacccgcttcttggcctggaagactgctcgcccgaggttgcccccaaatgacgtatcttcttgcaggcgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagccatttattgctcagaaacacagtcgtccaggtccacgttgaccaggtcgcaggccgagcaggcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcatctgaagcatgcccgcgtggcgagaacatttgttttggtacctgtcggcaaagtccaccggagctccttccgcgtctgacgtcgatgggtccgtgactgagggacaggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggctgctggtgctcgaaggtggtgctgttcccgtcgatcacggcgcgcatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 432 - protein, 729 aa, Adeno-associated virus; identical to SEQ ID NO: 160

SEQ ID NO: 433 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 434 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 435 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 436 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 437 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 438 - protein, 738 aa, Adeno-associated virus; identical to SEQ ID NO: 90

SEQ ID NO: 439 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 440 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 441 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 442 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 443 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 444 - protein, 737 aa, Adeno-associated virus
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 445 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 446 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 447 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 448 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 449 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 450 - protein, 738 aa, Adeno-associated virus
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 451 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 452 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 453 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 454 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 455 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 456 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 457 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 458 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 459 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 460 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 461 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 462 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 463 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 464 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 465 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 466 - protein, 734 aa, Adeno-associated virus; identical to SEQ ID NO: 291

SEQ ID NO: 467 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 468 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 469 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 470 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 471 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 472 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 473 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 474 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 475 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 476 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 477 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 478 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 479 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 480 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 481 - protein, 735 aa, Adeno-associated virus
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 482 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 483 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 484 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 485 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 486 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 487 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 488 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 489 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRWNPEIQYTSNYYKSTNVDFAVNTEGVYSEPRPIGTRYLTRNL

SEQ ID NO: 490 - protein, 738 aa, Adeno-associated virus; identical to SEQ ID NO: 488

SEQ ID NO: 491 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 492 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 493 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 494 - protein, 737 aa, Adeno-associated virus; identical to SEQ ID NO: 453

SEQ ID NO: 495 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 496 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 497 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 498 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 499 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 500 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 501 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 502 - protein, 736 aa, Adeno-associated virus; identical to SEQ ID NO: 2

SEQ ID NO: 503 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 504 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQRQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 505 - protein, 736 aa, Adeno-associated virus
MAADGYLPDWLEDNLSEGIREWLNLKPGAPQPKANQQKQDNARGLVLPGYKYLGPFNGLDKGDPVNEADAAALEHDKAYGQQLKAGDNPYLKYNHADAEFQERLQKDTSFGGNLGKAVFQAKKRILEPLGLVETPAKTAPGKKRPVDPSPQRSPDSSSGIGKKSPHPARKRLNFGQTGEAESVPDPQPIGEPPSDPSSVGSGTMAAGGGAPMADNNEGADGVGNSSGNWHCDSTWLGDRVITTSTRTWALPTYNNHLYKQISSQSGATNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQGTNATVQGAKLQFSQAGPSNMRDQARNWLPGPCYRQQRVSKTANDNNNSEYAWTGATKYHLNGRDSLVNPGPAMASHKDDEEKFFPMNGTLVFGKNGAGNSNVDIENVMITDEEEIRTTNPVATEQYGVVSDNLQSSNTRPITGDVDSQGVLPGMVWQDRDVYLQGPIWAKIPHTDGHFHPSPLMGGFGLKHPPPQILIKNTPVPANPATTFTPGKFASFITQYSTGQVSVQIEWELQKENSKRWNPEIQYTSNYNKSVNVDFTVDTNGVYSEPRPIGTRYLTRNL

SEQ ID NO: 506 - protein, 736 aa, Adeno-associated virus; identical to SEQ ID NO: 81

SEQ ID NO: 507 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 508 - protein, 736 aa, Artificial Sequence; identical to SEQ ID NO: 507
  Description of Artificial Sequence: Synthetic polypeptide

SEQ ID NO: 509 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQRANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 510 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDAFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 511 - DNA, 1803 bp, Bovine adeno-associated virus
acggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 512 - DNA, 1617 bp, Bovine adeno-associated virus
atgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 513 - DNA, 1173 bp, Bovine adeno-associated virus
atggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 514 - DNA, 1833 bp, Bovine adeno-associated virus
atggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 515 - DNA, 2211 bp, Bovine adeno-associated virus
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 516 - DNA, 4694 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccac

SEQ ID NO: 517 - protein, 390 aa, Bovine adeno-associated virus
MALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 518 - protein, 610 aa, Bovine adeno-associated virus
MATFYEVIVRVPFDVEEHLPGISDNFVDWVTGQIWELPPESDLNLTLIEQPQLTVADRIRRVFLYEWNKFSKQESKFFVQFEKGSEYFHLHTLVETSGISSMVLGRYVSQIRAQLVKVVFQNIEPRINDWVAITKVKKGGANKVVDSGYIPAYLLPKVQPELQWAWTNLEEYKLAALNLEERKRLVAQFQLESSQRSQEASSQRDVSADPVIKSKTSQKYMALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 519 - protein, 538 aa, Bovine adeno-associated virus
MRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 520 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVHIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTNKNFSGYRKNWLPGPMMKQQRFSKTASQNYKIPQGGNNSLLHYETRTTLDRRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 521 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 522 - protein, 736 aa, Bovine adeno-associated virus; identical to SEQ ID NO: 521

SEQ ID NO: 523 - protein, 600 aa, Bovine adeno-associated virus
TAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 524 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 525 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 526 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 527 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 528 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggggtcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctt

SEQ ID NO: 529 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 530 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 531 - DNA, 1797 bp, Artificial Sequence
  Description of Artificial Sequence: Synthetic polynucleotide
acggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 532 - DNA, 1989 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 533 - DNA, 1626 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 534 - DNA, 1323 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 535 - DNA, 960 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 536 - DNA, 1608 bp, Artificial Sequence
  Description of Artificial Sequence: Synthetic polynucleotide
atggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 537 - DNA, 2232 bp, Artificial Sequence
  Description of Artificial Sequence: Synthetic polynucleotide
atgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 538 - protein, 535 aa, Artificial Sequence
  Description of Artificial Sequence: Synthetic polypeptide
MAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 539 - protein, 440 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 540 - protein, 319 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 541 - protein, 662 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 542 - protein, 541 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 543 - protein, 743 aa, Artificial Sequence
  Description of Artificial Sequence: Synthetic polypeptide
MSLISDAIPDWLERLVKKGVNAAADFYHLESGPPRPKANQQTQESLEKDDSRGLVFPGYNYLGPFNGLDKGEPVNEADAAALEHDKAYDLEIKDGHNPYFEYNEADRRFQERLKDDTSFGGNLGKAIFQAKKRVLEPFGLVEDSKTAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 544 - protein, 598 aa, Artificial Sequence
  Description of Artificial Sequence: Synthetic polypeptide
TAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 545 - DNA, 4694 bp, Artificial Sequence
  Description of Artificial Sequence: Synthetic polynucleotide
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 546 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 547 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 548 - DNA, 2211 bp, Artificial Sequence
  Description of Artificial Sequence: Synthetic polynucleotide
atggcttccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcagagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattctactggccaagtcagcgtggagattgaatgggagctgcagaaagaaaacagcaaacgctggaatcccgaagtgcagtatacatctaactatgcaaaatctgccaacgttgatttcactgtggacaacaatggactttatactgagcctcgtcccattggcacccgttacctcacccgtcccctgtaa

SEQ ID NO: 549 - protein, 736 aa, Artificial Sequence
  Description of Artificial Sequence: Synthetic polypeptide
MASDGYLPDWLEDNLSEGIREWWDLKPGAPKPKANQQKQDDGRGLVLPGYKYLGPFNGLDKGEPVNAADAAALEHDKAYDQQLRAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 550 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 551 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 552 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcaatcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacataaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacattgatttcactgtggacaacaatggactttatactgagcctcgccccattggcacccgttacctcacccgtccccagtaa

SEQ ID NO: 553 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANIDFTVDNNGLYTEPRPIGTRYLTRPQ

SEQ ID NO: 554 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtaccttcggtataaccacgccgacgccgagtttcaggagcgtctgcaagaagatacgtcttttgggggcaacctcgggcgagcagtcttccaggccaaaaagagggttctcgaacctctcggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctcccgcagccccctcaggtgtgggatctcttacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagtgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 555 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEQSPQEPDSSSGIGKTGQQPAKKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQCVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 556 - DNA, 2211 bp, Artificial Sequence
  Description of Artificial Sequence: Synthetic polynucleotide
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 557 - protein, 736 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 558 - DNA, 2208 bp, Artificial Sequence
  Description of Artificial Sequence: Synthetic polynucleotide
  modified_base (955)..(955): a, t, c, or g
  misc_feature (955)..(955): n is a, c, g, or t
  modified_base (971)..(972): a, t, c, or g
  misc_feature (971)..(972): n is a, c, g, or t
  modified_base (981)..(981): a, t, c, or g
  misc_feature (981)..(981): n is a, c, g, or t
  modified_base (986)..(986): a, t, c, or g
  misc_feature (986)..(986): n is a, c, g, or t
  modified_base (1235)..(1235): a, t, c, or g
  misc_feature (1235)..(1235): n is a, c, g, or t
  modified_base (1694)..(1696): a, t, c, or g
  misc_feature (1694)..(1696): n is a, c, g, or t
  modified_base (1698)..(1698): a, t, c, or g
  misc_feature (1698)..(1698): n is a, c, g, or t
  modified_base (1763)..(1765): a, t, c, or g
  misc_feature (1763)..(1765): n is a, c, g, or t
  modified_base (1778)..(1778): a, t, c, or g
  misc_feature (1778)..(1778): n is a, c, g, or t
  modified_base (2204)..(2204): a, t, c, or g
  misc_feature (2204)..(2204): n is a, c, g, or t
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaataacaattggggattccggcccaagagactcaacttcaaactcttcaacntccaagtcaaggaggnnacgacgaangatgncgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttacctncagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagagannncnaagccactaaccccgtggccactgaaagatttgggactgtggcagtcaatctccaagcagcacannnaccctgcgaccgnagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtccccngtaa

SEQ ID NO: 559 - protein, 723 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNQVKETTDVTTIANNLTSTVQVFSDSEYQLPYVLGSAHQGCLPPFPADVFMIPQYGYLTLNNGSQAVGRSSFYCLEYFPSQMLRTGNNFTSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEATNPVATERFGTVAVNLQSSPATDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 560 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggtcagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacgctccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 561 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 562 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcaaactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcgggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacgaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtatacagagcctcgccccattggcaccagatacctgactcgtaatctgtaa

SEQ ID NO: 563 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDANSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSRAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYTEPRPIGTRYLTRNL

SEQ ID NO: 564 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaataactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcactcaatactccacaggacaagtgagcgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 565 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 566 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRNQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNQ

SEQ ID NO: 567 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggaacgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcggaaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatcagtaa

SEQ ID NO: 568 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgatccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtatgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 569 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 570 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatgactgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcaactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 571 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggggcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactggaggtgtatatagtgaaccccgccccattggcaccagatacctgactcgtaatctgtaattgcttgttaatcaataaaccgtttaattcgtttcagttgaactgcggcc

SEQ ID NO: 572 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggactcggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattgacaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 573 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcctccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggatccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccaggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 574 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacagggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaagaaaaacagcaagcgctggaacccggagatccagtacacttccaactattacaagtctaataatgttgaatttgctgttaacactgaaggtgtatatagtgaaccccgccccattggcaccagatacctgactcgtaatctgtaattgcttgttaatcaataaaccgtttaattcgtttcagttgaactgcggcc

SEQ ID NO: 575 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacgggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 576 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagtagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggatttcggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 577 - DNA, 2580 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcgggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggaactgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaatt

SEQ ID NO: 578 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtctttcaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcatgtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 579 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccgatcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgtacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 580 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgccacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgctgccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacatgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcaatgtggccggacccagcaacatggctgtccagggaagaaactacatacctggacccagctaccgacaacaacgtgtctcaaccactgtgactcaaaacaacaacagcgaatttgcctggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcatggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 581 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 582 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagcggcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 583 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcgcggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 584 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaaattgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccagtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattgcaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 585 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgtctgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgataagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 586 - protein, 736 aa, Artificial Sequence
  Description of Artificial Sequence: Synthetic polypeptide
MTADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKQLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 587 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTGGVYSEPRPIGTRYLTRNL

SEQ ID NO: 588 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIDKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 589 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVLQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGSSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 590 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDRAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKKNSKRWNPEIQYTSNYYKSNNVEFAVNTEGVYSEPRPIGTRYLTRNL

SEQ ID NO: 591 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQARAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 592 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAVDAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 593 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPREPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 594 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASCGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 595 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPINAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTYGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 596 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPHDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFNVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSMEIEWELQKENSKRWNPEIQYTSNYYKSNNVEFAVNTEGVYSEPRPIGTRYLTRNL

SEQ ID NO: 597 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 598 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWERQKENSKRWNPEIQYTSNYYKSNNVEFAVNTEGVYSEPRPIGTRYLTRNL

SEQ ID NO: 599 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFADSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 600 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEIAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYCKSNNVEFAVNTEGVYSEPRPIGTRYLTRNL

SEQ ID NO: 601 - protein, 736 aa, Artificial Sequence; identical to SEQ ID NO: 597
  Description of Artificial Sequence: Synthetic polypeptide

SEQ ID NO: 602 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcggctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctgggacccggagatccagtacacttccaactattacaagtctaataatgttgaatttgctgttaatactgaaggtgtatatagtgaaccccgccccattggcaccagatacctgactcgtaatctg

SEQ ID NO: 603 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccgcttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacgcccctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 604 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcagcgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccgcgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 605 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacacggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 606 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcggctcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtagcaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggcagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagcacacttccaactattacaagtctaataatgttgaatttgctgttaatactgaaggtgtatatagtgaaccccgccccattggcaccagatacctgactcgtaatctg

SEQ ID NO: 607 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaggctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaagccaaggaatacttccgggtatggtttggcaggacagagatgtgtacctgcaaggacccatttgggccaaaattcctcacacggacggcaactttcacccttctccgctgatgggagggtttggaatgaagcacccgcctccccagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 608 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgcccgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctggaggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggccttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacgagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 609 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggacaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccaattcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 610 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagccatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgacaaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 611 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaatgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccgggctcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 612 - DNA, 2208 bp, Artificial Sequence
  Description of Artificial Sequence: Synthetic polynucleotide
atggctgccgatggttattttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaatctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatctcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctgtggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 613 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagcggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 614 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcggggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcggcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 615 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacctgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 616 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaagaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 617 - DNA, 2208 bp, Artificial Sequence
  Description of Artificial Sequence: Synthetic polynucleotide
  modified_base (1325)..(1325): a, t, c, or g
  misc_feature (1325)..(1325): n is a, c, g, or t
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaccagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccnatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccggatatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 618 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagctacaaagaaggagaggacagtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagaccctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 619 - DNA, 2208 bp, Artificial Sequence; identical to SEQ ID NO: 602
  Description of Artificial Sequence: Synthetic polynucleotide

SEQ ID NO: 620 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccagggcaaatcaacaacatcaagacaacgctcgaggtcttgtgcttccgggttacaaataccttggacccggcaacggactcgacaagggggagccggtcaacgcagccgacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactgtcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaacgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcccatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 621 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaagaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccacccatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatggtgaaccccgccccattggcaccagatacctgactcgtaatctg

SEQ ID NO: 622 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgaccggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 623 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcagccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcaattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccggcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaagaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 624 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacagataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggtaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtatcggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccgtcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtggaccccgccccattggcaccagatacctgactcgtaatctg

SEQ ID NO: 625 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 626 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacgtcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggaggcaacccgtgcctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcagatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaaggccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattgacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatggatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 627 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagcctaataatgttgaatttgctgttaatactgaaggtgtatatagtgaaccccgccccattggcaccagatacctgactcgtaatctg

SEQ ID NO: 628 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcctcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctactatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 629 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgtgcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcacgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattgggccccgatacctgactcgtaatttt

SEQ ID NO: 630 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 631 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggcggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcgagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtccagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgcctcaaccactgtgactcaaaacaacaacagcgaatttgcttggcctggagcttcttcttgggctctcaatggacgtaatagcttgatgaatcctggacctgctatggccagccacaaagaaggggaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 632 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagcccccccaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattagcggttctggacagaatcaacaaacgctaaaattcagtgtggccggacccagcaacatggctgtccagggaagaaactacatacctggacccagctaccgacaacaacgtgtctcaaccactgtgactcaaaacaacagcagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatactttcgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 633 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 634 - DNA, 2208 bp, Artificial Sequence; identical to SEQ ID NO: 633
  Description of Artificial Sequence: Synthetic polynucleotide

SEQ ID NO: 635 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcgactacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcagggcagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 636 - DNA, 2208 bp, Artificial Sequence; identical to SEQ ID NO: 633
  Description of Artificial Sequence: Synthetic polynucleotide

SEQ ID NO: 637 - DNA, 2208 bp, Artificial Sequence
  Description of Artificial Sequence: Synthetic polynucleotide
atggctgccgatggttatcctccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggggacaacccgcacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcccgtagagcagtctcctcaggaaccggactcctccgcgggtattggcaaatcgggtgcacagcccgctaagaagagactcaatttcggtcagactggcgacactgagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaggctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 638 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagtttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 639 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacttacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcaccaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatatcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 640 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtttagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttctggcaaacaaggaactggaagagacaacgtggatgcgaacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttgaaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 641 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatagcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcgaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagcttttcaacattcgggtcaaagaggttacggacaacaatggagtcaagaccatcaccaataaccttaccagcacggtccaggtcttcacggactcagactatcagctcccgtacgtgcttgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcgaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 642 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggcgcacagcccgctaaaaagagactcaatttcggtcagactggcgacacagagccagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcgggcgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgcgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 643 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgggttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagtccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggagctggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 644 - DNA, 2208 bp, Artificial Sequence
  Description of Artificial Sequence: Synthetic polynucleotide
  modified_base (377)..(377): a, t, c, or g
  misc_feature (377)..(377): n is a, c, g, or t
atggctgccgatggttatcttccagattggctcgaggacaaccttagtgaaggaattcgcgagaggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcntgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcggggaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcccggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 645 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 646 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccagagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctggactctttcatcacccagtattctactggccaagtcagcgtggagatcgagtgggagctgcagaaggaaaacagcaagcgctggaacccggtgatccagtacacttccaactattacaagtctaataatgttgaatttgctgttaatactgaaggtgtatatagtgaaccccgccccattggcaccagatacctgactcgtaatctg

SEQ ID NO: 647 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtggggcctactacaatggcttcaggcggtggcgcaccaatggcagacaataacgaaggcgtcgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgttacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagccacaaagcttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 648 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagagacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcgttcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 649 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgtcttttgggggcaacctcgggcgagcagtcttccaggccaagaagcgggttctcgaacctctcggtctggttggggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 650 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacgacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgcgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggcctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 651 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccgggagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgactttactgtggacaacaatggactttatactgagcctcgccccattggcacccgttaccttacccgtcccctg

SEQ ID NO: 652 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctgtggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 653 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcaactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcaccagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccgacgttgattttactgtggacaacaatggactttatactgagcctcgccccattggcacccgttaccttacccgtcccctg

SEQ ID NO: 654 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcctccgtacgtcctcggctctgcgcaccagggctgcctccctccgttcccggcggacgtgttcatgattccgcaatacggccacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgacgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 655 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaagagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctacgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaccacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacgacaatggactttatactgagcctcgccccattggcacccgttaccttacccgtcccctg

SEQ ID NO: 656 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgctacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacgacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 657 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagctccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagcgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcgaaatctgccaacgttgattttactgtggacaacaatggactttatactgagcctcgccccgttggcacccgttaccttacccgtcccctg

SEQ ID NO: 658 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccatacctgcggtataaccacgccgacgccgagtttcaggagcgtctgcaagaaaatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccactttccaccacgtgactggcagcgactcatcaacaacaattggggattccggcccaagagactcaacttcaaactcttcaacatccaagtcaaggaggtcacgtcgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggtccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 659 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcacgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgggcctcgccccattggcacccgttaccttacccgtcccctg

SEQ ID NO: 660 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgccccaggaaattggcattgcgactccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcacagctatggcctcacacaaagacgacgaagacaagttctttcccatgagcggtgtcatgatttttggaaaagagagcgccggagcttcaaacactgcattggacaatgtcatgattacaggcgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 661 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacagactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaggaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcgccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcggccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatatagcctcaatgggcgtgaatccatcatcaaccctggcactgctatggcctcacacaaagacgacgaagacaagttctttcccatgggcggtgtcatgatttttggaaaagagagcgccggagcttcaaacactgcattggacaatgccatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 662 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactctaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 663 - DNA, 2208 bp, Artificial Sequence
  Description of Artificial Sequence: Synthetic polynucleotide
atggctgccgatggttatctcccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcagcgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaagagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 664 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaaggggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 665 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgtttatgattccgcagtacggctacctaacgctcaacaatggcagccaggccgtgggacgttcatccttttactgcccggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 666 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcgacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 667 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacactcgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagttacgggcacagccagagcctggaccggctgatgaatcttctcatcgaccaatacctgtattacctgaacagaactcaaaatcagtccggaagtgcccaaaacaaggacttgctgtttagccgtgggtctccagctggcatgtttgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 668 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaatgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgcggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 669 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacgggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtccgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 670 - DNA, 2208 bp, Artificial Sequence
  Description of Artificial Sequence: Synthetic polynucleotide
  modified_base (305)..(305): a, t, c, or g
  misc_feature (305)..(305): n is a, c, g, or t
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggngcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggccacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgtccccggcggacgtgttcatgattccgcagtacggctacctaacactcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 671 - DNA, 2208 bp, Artificial Sequence
  Description of Artificial Sequence: Synthetic polynucleotide
atggctgccgatggttattttccagattggctcgaggacaacctttctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaggacaggccagcagcccgctaaaaagagactcaattttggtcagactggcgactcagagtcagtccccgacccacaacctctcggagaacctccagcgacccccgctgctgtgggacctactacaatggcttcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcccagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatagtgagcctcgccccattggcacccgttaccttacccgtcccttg

SEQ ID NO: 672 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaacctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagactacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 673 - DNA, 2208 bp, Artificial Sequence
  Description of Artificial Sequence: Synthetic polynucleotide
atggctgccgatggttatcctccagattggctcgaggacaacctctctgagggcattcgcgagtggtgggacttgaaacctggagtcccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 674 - DNA, 2196 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagccttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacccatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctt

SEQ ID NO: 675 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactctcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 676 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacctatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggaacttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 677 - DNA, 2208 bp, Artificial Sequence
  Description of Artificial Sequence: Synthetic polynucleotide
atggctgccgatggttatcttccagattggctcgaggacagcctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacgatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgcccaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaataccagtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 678 - DNA, 2208 bp, Artificial Sequence; identical to SEQ ID NO: 669
  Description of Artificial Sequence: Synthetic polynucleotide

SEQ ID NO: 679 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcgggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctg

SEQ ID NO: 680 - protein, 736 aa, Artificial Sequence
  Description of Artificial Sequence: Synthetic polypeptide
MAADGYLPDWLEDNLSEGIREWWALKPGAPQPKANQQHQDNARGLVLPDYKYLGPGNGLDKGEPVNAADVAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDGVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLPKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 681 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKRRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQIKEVTDNNGVKTIANNLTSTVQVFTDLDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 682 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVSDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPSPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDDVDADKVIITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 683 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHAGAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGAGGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHGGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRSYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 684 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSHAHSQSLDRLMNPLIDQYLHYLSKTINGSGQNQQTLKFSVAGHSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIGWELQKENSKRWNPEIQYTSNYYKSNNVEFAVNTEGVYSEPRPIGTRYLTRNL

SEQ ID NO: 685 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNRLYKQISNSTSGGSSNDNAYFGYSTPWGYFDFNRFHCHFSPRDWQRLINNNWGFRPKRLNFKPFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 686 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 687 - protein, 736 aa, Artificial Sequence; identical to SEQ ID NO: 686
  Description of Artificial Sequence: Synthetic polypeptide

SEQ ID NO: 688 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKSGQQPAKKRLNFGQTGDSESVPDPQPLGEPPATPAALGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSKAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 689 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 690 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFGYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWDPEIQYTSNYYKSNNVEFAVNTEGVYSEPRPIGTRYLTRNL

SEQ ID NO: 691 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCRFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNAPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 692 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 693 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNTAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 694 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGSNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPAATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQHTSNYYKSNNVEFAVNTEGVYSEPRPIGTRYLTRNL

SEQ ID NO: 695 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFRLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQSQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 696 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWRYFDFNRFHCHFSPRDWQRLINNWGFRPKRLNFKLFNIQVKEVTDNNGVKTIANNLTSTVQAFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDELNSFITQYSTGQVSVEIEWELQKENSKRWNPEIQYTSNYYKSNNVEFAVNTEGVYSEPRPIGTRYLTRNL

SEQ ID NO: 697 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQDKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 698 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRAITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMTTNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 699 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQTKKRLLEPLGLVEEAAKTAPGKKRPVEQSPQEPGSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 700 - protein, 736 aa, Artificial Sequence
  Description of Artificial Sequence: Synthetic polypeptide
MAADGYFPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGESPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYLPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAVASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 701 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQAATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 702 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWRRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 703 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNLYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 704 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 705 - protein, 736 aa, Artificial Sequence
  Description of Artificial Sequence: Synthetic polypeptide
  MOD_RES (442)..(442): Any amino acid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISTSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDXYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPDMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 706 - protein, 736 aa, Artificial Sequence; identical to SEQ ID NO: 686
  Description of Artificial Sequence: Synthetic polypeptide

SEQ ID NO: 707 - protein, 736 aa, Artificial Sequence; identical to SEQ ID NO: 690
  Description of Artificial Sequence: Synthetic polypeptide

SEQ ID NO: 708 - protein, 736 aa, Artificial Sequence
  Description of Artificial Sequence: Synthetic polypeptide
MAADGYLPDWLEDNLSEGIREWWALKPGAPQPRANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDCQLPYVLGSAHEGCLPPFPADVFMIPQYGYLTLNDGSQAVGRSSFYCLEYFPSQMLRTGNNFQFSYEFENVPFHSSYAHSQSLDRLTNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESHGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 709 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPPIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYGEPRPIGTRYLTRNL

SEQ ID NO: 710 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDRQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 711 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCNSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPGNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 712 - protein, 736 aa, Artificial Sequence
  Description of Artificial Sequence: Synthetic polypeptide
MAADGYLPDWLEDNLSEGIREWWALKPGAPQPKANQQHQDNARGLVLPGYRYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTVANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSGPRPIGTRYLTRNL

SEQ ID NO: 713 - protein, 736 aa, Artificial Sequence; identical to SEQ ID NO: 123
  Description of Artificial Sequence: Synthetic polypeptide

SEQ ID NO: 714 - protein, 736 aa, Artificial Sequence
  Description of Artificial Sequence: Synthetic polypeptide
MAADGYLPDWLEDNLSEGIREWWALKPGAPQPKANQQRQDNARGLVLPGYKYLGPGNGLDKGEPVNAADAAALEHDKAYDQQLKAGGNPCLKYNHADAEFQERLKEDTSFGGNLGRAVFQAKKRLLEPLGLVEEAAKTAPGKKRPVEQSPQEPDSSAGIGRSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKAIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGSGQNQQTLKFSVAGPSNMAVQGRNYIPGPSYRQQRVSTTVTQNNNSEFAWPGASSWALNGRNSLMDPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 715 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKPNNVEFAVNTEGVYSEPRPIGTRYLTRNL

SEQ ID NO: 716 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRPLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPTMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 717 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALVHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFTIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGPRYLTRNF

SEQ ID NO: 718 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 719 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFELFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQSSYEFENVPFHSSYAHSQSLDRLMNPLIDQYLYYLSKTINGSGQNQQTLKFSVAGPSNMAVQGRNYIPGPSYRQQRASTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 720 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPPGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISGSGQNQQTLKFSVAGPSNMAVQGRNYIPGPSYRQQRVSTTVTQNNSSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILSGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 721 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 722 - protein, 736 aa, Artificial Sequence; identical to SEQ ID NO: 721
  Description of Artificial Sequence: Synthetic polypeptide

SEQ ID NO: 723 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLDYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQGRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 724 - protein, 736 aa, Artificial Sequence; identical to SEQ ID NO: 721
  Description of Artificial Sequence: Synthetic polypeptide

SEQ ID NO: 725 - protein, 736 aa, Artificial Sequence
  Description of Artificial Sequence: Synthetic polypeptide
MAADGYPPDWLEDNLSEGIREWWALKPGAPQPKANQQHQDNARGLVLPGYKYLGPGNGLDKGEPVNAADAAALEHDKAYDQQLKAGDNPHLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDRLNSFITQYSTGQVSVEIEWELQKENSKRWNPEIQYTSNYYKSNNVEFAVNTEGVYSEPRPIGTRYLTRNL

SEQ ID NO: 726 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 727 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLTNNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYIPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 728 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLISGKQGTGRDNVDANKVMITNEEEIKTTNPVATESYGQVATNHQSAQAQAQTGWVQNQGILPGMVWQDRDVYLQGPIWAKIPHTDGNFHPSPLMGGFEMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 729 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTIASGGGAPVADNNEGADGVGSSSGNWHCDSQWLGDRVITTSTRTWALPTYNNHLYKRISNSTSGGSSNDNAYFGYSTPWGYFDFNRFHCHFSPRDWQRLINNNWGFRPKRLNFKLFNIRVKEVTDNNGVKTITNNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTRNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 730 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTEPVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPAGVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTATQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 731 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAGFQERLKEDTSFGGNLGRAVFQAKKRLLEPLGLVEEAAKTAPGKKRPVEQSPQEPDSSAGIGKSGAQPAKKRLNFGQTGDTESVPVPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGAGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 732 - protein, 736 aa, Artificial Sequence
  Description of Artificial Sequence: Synthetic polypeptide
  MOD_RES (126)..(126): Any amino acid
MAADGYLPDWLEDNLSEGIRERWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLXEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSPDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 733 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 734 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLDSFITQYSTGQVSVEIEWELQKENSKRWNPVIQYTSNYYKSNNVEFAVNTEGVYSEPRPIGTRYLTRNL

SEQ ID NO: 735 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGVDGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKLASFITQYSTGQVSVEIEWELQKENSKRWNPEVQYTSNYAKSANVDFTVDNNGLYTEPRPIGTRYLTRPL

SEQ ID NO: 736 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKRRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 737 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVGEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 738 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPRPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGPPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 739 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGGSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 740 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 741 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQQLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSTSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSADVDFTVDNNGLYTEPRPIGTRYLTRPL

SEQ ID NO: 742 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQPPYVLGSAHQGCLPPFPADVFMIPQYGHLTLNNGSQAVGRSSFYCLEYFPSQMLRTGNNFTFSYTFEEVPFHSSYAHSQSLDRLTNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 743 - protein, 736 aa, Artificial Sequence
  Description of Artificial Sequence: Synthetic polypeptide
MAADGYLPDWLEDNLSEGIREWWDLKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHATGTLPGMVWQDRDVYLQGPIWAKIPHTDGHFHPSPLMGGFGLKNPPPQILIKTTPVPANPPAEFSATKFASFITQYSTGQVSVEIEWELQKENSKRWNPEVQYTSNYAKSANVDFTVDDNGLYTEPRPIGTRYLTRPL

SEQ ID NO: 744 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSLQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNDNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 745 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEAPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPVGTRYLTRPL

SEQ ID NO: 746 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQENTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFPPRDWQRLINNNWGFRPKRLNFKLFNIQVKEVTSNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 747 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGTSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTGPRPIGTRYLTRPL

SEQ ID NO: 748 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNAPGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITGEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 749 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNRLDKGEPVNAADAAALEHDKAYDQQLKAGDNPYLRYNHADAEFQERLQEDTSFGGNLGRAVFQAKKRVLEPLGLVEEGAKTAPGRKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGGQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYSLNGRESIINPGTAMASHKDDEDKFFPMGGVMIFGKESAGASNTALDNAMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 750 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNSTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGTLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 751 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVSAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKERLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 752 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEGEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 753 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCPEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 754 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSDTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 755 - protein, 736 aa, Artificial Sequence
  Description of Artificial Sequence: Synthetic polypeptide
MAADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYGHSQSLDRLMNLLIDQYLYYLNRTQNQSGSAQNKDLLFSRGSPAGMFVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 756 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLMLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPAATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 757 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 758 - protein, 736 aa, Artificial Sequence
  Description of Artificial Sequence: Synthetic polypeptide
  MOD_RES (102)..(102): Any amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQXRLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGHSTPWGYFDFNRFHCHFSPRDWQRLINNNWGFRPKRLNFKLFNIQVKEVTTNDGVTTIANNLTSTVQVFSDSEYQLPYVLGSAHQGCLPPSPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 759 - protein, 736 aa, Artificial Sequence
  Description of Artificial Sequence: Synthetic polypeptide
MAADGYFPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGRTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSPDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYSEPRPIGTRYLTRPL

SEQ ID NO: 760 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQTSSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDYNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 761 - protein, 736 aa, Artificial Sequence
  Description of Artificial Sequence: Synthetic polypeptide
MAADGYPPDWLEDNLSEGIREWWDLKPGVPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 762 - protein, 732 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQAFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDPYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYL

SEQ ID NO: 763 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHSHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 764 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDLYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGTSNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 765 - protein, 736 aa, Artificial Sequence
  Description of Artificial Sequence: Synthetic polypeptide
MAADGYLPDWLEDSLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTPNNGSQAVGRSSFYCLEYFPSQMLRTGNNFTFSYTFEEVPFHSSYAHSQSLDRLMNPLIDQYQYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 766 - protein, 736 aa, Artificial Sequence; identical to SEQ ID NO: 757
  Description of Artificial Sequence: Synthetic polypeptide

SEQ ID NO: 767 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSRAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 768 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgcctcccgccgtttccagcggacgtcttcatggtccctcagtatggatacctcaccctgaacaacggaagtcaagcggtgggacgctcatccttttactgcccggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcaccctattggaacccggtatctcacacgaaacttgtaa

SEQ ID NO: 769 - DNA, 2211 bp, Artificial Sequence
  Description of Artificial Sequence: Synthetic polynucleotide
atggctgctgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactgttgccaataaccttaccagcacggttcaagtgtttacggactcggagtatcaactcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 770 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccggccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacggcaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtgtggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 771 - DNA, 2212 bp, Artificial Sequence
  Description of Artificial Sequence: Synthetic polynucleotide
  modified_base (1283)..(1283): a, t, c, or g
  misc_feature (1283)..(1283): n is a, c, g, or t
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggaccgggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggtccaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacggcagctacgctcacagccngagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagacttttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaactcgtaa

SEQ ID NO: 772 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcttgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccggccaatcaggagcttcaaacgacaaccactactttggctacagcaccccctgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatcccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 773 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtgcctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtagcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatggatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacctgtaa

SEQ ID NO: 774 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcaacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 775 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcggacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagtgcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 776 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaaggggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgttcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagttcggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttgaacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 777 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacgaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccacctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 778 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccctcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagatagtgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 779 - DNA, 2205 bp, Artificial Sequence
  Description of Artificial Sequence: Synthetic polynucleotide
atgactgacggttaccttccagattggctagaggacaacctctctgagggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcaactggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacctttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 780 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttcttaccacgtgactggcagcgactcatcaacaacaactggggcgtgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcgacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 781 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacgagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 782 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacggaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattccccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggcggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 783 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctaccgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 784 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttcagggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaaccccttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacccggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaataactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgcccggacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 785 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaggctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacggaggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 786 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatcctccgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctagtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 787 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacactgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagagcacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 788 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtgcaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctattggaacccgataccttacccgacccctttaa

SEQ ID NO: 789 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacaccgaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcgcgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 790 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacggggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagcgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 791 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttactaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagggggacgtgtacctccaaggacccatctgggccaagatcccagagacgggggcgcactttcacccctctccggccatgggcggattcggactcaagcacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 792 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccgagaggtggaacccagagatccagtacacaaacaactacaacgacccccagtttgtggactttgccccggacagcaccggggaatacagaaccaccagacctattggaacccgataccttacccgacccctttaa

SEQ ID NO: 793 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacagcgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccgccagacctatcggaacccgataccttacccgacccctttaa

SEQ ID NO: 794 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatgaccaccaacaaccagagctccaccactgcccccgcgaccggcacgtacaacctccaggaaatcgtgcccggcagcgtgtggatggagagggacgtgtacccccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacaggaccaccagacctatcggaacccgataccttacccgacccctttaa

SEQ ID NO: 795 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcctctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatgaagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 796 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaggcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccaccccgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 797 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacccacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagtcgaacggcatgaccaacaacctccggggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 798 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacagcgtcggcgggcagatggccaccaacaaccagagctccaccactgcccccacgaccggcacgtacaacctccaggaaatcgtgcccggcagcgtgtggatggagagggacgtgtacctccaaggacccatctgggccaagatcccagagacgggggcgcactttcacccctctccggccatgggcggattcagactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 799 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccgcgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcggcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaataccaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 800 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggtagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcggcaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggggcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccctcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 801 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgagccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatgcagaaccaccagacctatcggaacccgataccttacccgacccctttaa

SEQ ID NO: 802 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcctcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtgggccagtacttgtaccgcttcgtgagcacaaataacactggcggagtccagttcaacgagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggccaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 803 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggcctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccatcatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgcccccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 804 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcctctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 805 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgccaacagggcagacgaggtcgcgcgagagcacgacatctcgtacaacgagcagcttgaggcgggagacaacccctacctcaagtacaaccacgcgggcgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccggctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataatactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 806 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccgccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 807 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagccgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 808 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 809 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcgccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 810 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 811 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggctgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagccaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaaccttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggtgcacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccggagatccagtacacaaacaactacaacgacccccagtttgtggactttgccccggacagcaccggggaatacagaaccaccagacctatcggaacccgataccttacccgacccctttaa

SEQ ID NO: 812 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaggcaacgccaacgcctactttggatacagcaccccctgggggtactttgactttaaccgcttccacagccactggagcccccgggactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaagggaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 813 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacgtccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggtgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 814 - DNA, 2175 bp, Artificial Sequence
  Description of Artificial Sequence: Synthetic polynucleotide
  modified_base (1652)..(1652): a, t, c, or g
  misc_feature (1652)..(1652): n is a, c, g, or t
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaggaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcagcatgctcatcaccancgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 815 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 816 - DNA, 2205 bp, Artificial Sequence; identical to SEQ ID NO: 84
  Description of Artificial Sequence: Synthetic polynucleotide

SEQ ID NO: 817 - DNA, 2234 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctc

SEQ ID NO: 818 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCPEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPHPIGTRYLTRNL

SEQ ID NO: 819 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTVANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 820 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANGNNNSNFPWTAASKYHLNGRDSLVNPGPAMASHKDDEEKFFPMHGNLIFGKEGTTASNAELDNVMITDEEEIRTTNPVATEQCGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 821 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADAFMVPQYGYLTLNNGSQAVGRSSFYCLEYFPSQMLRTGNNFQFSYTFEDVPFHGSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNS

SEQ ID NO: 822 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQLARKRLNFGQTGDSESVPDPQPLGEPPAAPTSLGSNTMASGGGAPMADNNEGADGVGNSSGNWHCDSQWLGDRVITTSTRTWALPTYNSHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 823 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPCLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGSAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMDPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 824 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGNRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 825 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATVQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 826 - protein, 735 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKGILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVFGSAHQGCLPPFPADVFMVPQYGYLTLNNGSQAVGRSSFYCLEYFPSQMLRTGNNFQFSYTFEDVPFHSSYAHSQSSDRLMNPLIDQYLYYLNRTQGTTSGTTNQSRLLFSQAGPQSMSLQARNWLPGPCYRQQRLSKTANDNNNSNFPTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 827 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDEGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 828 - protein, 668 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGILTLTDSTATSHHVTGSDSLTTTGDSGPRNSASSSSTSKLKRSRRTMARRLLPITLPARFKCLRTRSISSRTCSGRRTKAVSRRFQRTPSWSLSMDTSPTTEVKRWDAHPFTAWSTSLRRCGLEITSNSAIPSRMYLFTAATLTARVWIAILLLISICTTTERKEQPLEQPTNHGCFLARLGLSLCLCRPEIGYLGPATGNRDFQRLLTTTTTVTFLGQRPANIISMAATRWIQDQLWPVTRTMKKNFSLCTAIRGPYLAWCGKIVTCTFKDLSGQRFLTRMDTFILLLWEALDNIRLLKSSKILRYRQILRRLSARPSLLHLSLSTPLDRSAWKLSGSYRKKTANVGIQRFSTLPTTTSLLMWTLLTLMVFIVNLALLEPGISHETC

SEQ ID NO: 829 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAATGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNLSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 830 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFLPRDWQRLINNNWGVRPKAMRVKIFNIQVKEVTTSNGETTVANNLTSTVQIFADSSYELPYVMDAGQEGSLPPFPNDVFMVPQYGYCGLVTGDTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 831 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDEGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 832 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDGTGAGDGPPEGSTSGAMSDDSEMRAAAGGAAVEGGQGADGVGNASGDWHCDSTWSEGHVTTTSTRTWVLPTYNNHLYKRLGESLQSNTYNGFPTPWGYFDFNRFHCHFSPRDWQRLINNNWGMRPKAMRVKIFNIQVKEVTTSNGETTAANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 833 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYRGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 834 - protein, 734 aa, Artificial Sequence
  Description of Artificial Sequence: Synthetic polypeptide
MTDGYLPDWLEDNLSEGVREWWALQPGAPKPKANQQHQDNARGLVLQGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTRSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSARTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 835 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQERLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETEAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 836 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSSGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 837 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKSTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 838 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVACNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 839 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGAYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 840 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADGVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQAFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 841 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYVPPQPNGMTNNLQGSNTYALENTMIFNSQPANPGTTATYLEGNMLITSESETQPVNRVAYNVGGQMATNNQSSTTAPATGTYNLQEIVPGSVWMEGDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 842 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSERWNPEIQYTNNYNDPQFVDFAPDSTGEYRTTRPIGTRYLTRPL

SEQ ID NO: 843 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYSEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTARPIGTRYLTRPL

SEQ ID NO: 844 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMTTNNQSSTTAPATGTYNLQEIVPGSVWMERDVYPQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 845 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFLCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMKRDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 846 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTPSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 847 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTHKNWFPGPMGRTQGWNLGSGVNRASVSAFATTNRMELEGASYQVPPQSNGMTNNLRGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 848 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYSVGGQMATNNQSSTTAPTTGTYNLQEIVPGSVWMERDVYLQGPIWAKIPETGAHFHPSPAMGGFRLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 849 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFAATNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGGVWMERDVYLQGPIWAKIPETGAHFHPSPAMGGFGLKHPPPMMLIKNTPVPGNTTSFSDVPVSSFITQYSTGQVTVEMEWELKKENSKRWNPEIQYTNNYNDPQFVDFAPDSTGEYRTTRPIGTRYLTRPL

SEQ ID NO: 850 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKVVFQAKKRVLEPFGLVEEGAKTAPTGKRIDDHFPKRKKARTEEDSKPSTSSDAEAGPSGSQQLQIPAQPASSLGADTMSAGGGGPLGGNNQGADGVGNASGDWHCDSTWMGDRVVTKSTRTWVLPSYNNHQYREIKSGSVDGSNANAYFGYSTPWGYFDFNRFHSHWGPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSALATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 851 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGECRTTRPIGTRYLTRPL

SEQ ID NO: 852 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKILNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVGQYLYRFVSTNNTGGVQFNENLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQATVEMEWELKKENSKRWNPEIQYTNNYNDPQFVDFAPDSTGEYRTTRPIGTRYLTRPL

SEQ ID NO: 853 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTIIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 854 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSLSDVPVSSFITQYSTGQVTVEMEWELKKENSKRWNPEIQYTNNYNDPQFVDFAPDSTGEYRTTRPIGTRYLTRPL

SEQ ID NO: 855 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPANRADEVAREHDISYNEQLEAGDNPYLKYNHAGAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPGYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 856 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSATTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 857 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQPQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 858 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 859 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVAVEMEWELKKENSKRWNPEIQYTNNYNDPQFVDFAPDSTGEYRTTRPIGTRYLTRPL

SEQ ID NO: 860 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 861 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLAEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRAKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNLEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVVHNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 862 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGGNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKGNSKRWNPEIQYTNNYNDPQFVDFAPDSTGEYRTTRPIGTRYLTRPL

SEQ ID NO: 863 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGVHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 864 - protein, 724 aa, Artificial Sequence
  Description of Artificial Sequence: Synthetic polypeptide
  MOD_RES (551)..(551): Any amino acid
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGSMLITXESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 865 - protein, 736 aa, Artificial Sequence; identical to SEQ ID NO: 39
  Description of Artificial Sequence: Synthetic polypeptide

SEQ ID NO: 866 - protein, 734 aa, Artificial Sequence; identical to SEQ ID NO: 57
  Description of Artificial Sequence: Synthetic polypeptide

SEQ ID NO: 867 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 868 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 869 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 870 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIQSSQTPRQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 871 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTRTNPEAAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 872 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQNGGTSSSAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 873 - protein, 7 aa, Artificial Sequence
  Description of Artificial Sequence: Synthetic peptide
TLAVPFK

SEQ ID NO: 874 - protein, 7 aa, Artificial Sequence
  Description of Artificial Sequence: Synthetic peptide
KFPVALT

SEQ ID NO: 875 - protein, 6 aa, Artificial Sequence
  Description of Artificial Sequence: Synthetic peptide
LAVPFK

SEQ ID NO: 876 - protein, 5 aa, Artificial Sequence
  Description of Artificial Sequence: Synthetic peptide
AVPFK

SEQ ID NO: 877 - protein, 4 aa, Artificial Sequence
  Description of Artificial Sequence: Synthetic peptide
VPFK

SEQ ID NO: 878 - protein, 6 aa, Artificial Sequence
  Description of Artificial Sequence: Synthetic peptide
TLAVPF

SEQ ID NO: 879 - protein, 5 aa, Artificial Sequence
  Description of Artificial Sequence: Synthetic peptide
TLAVP

SEQ ID NO: 880 - protein, 4 aa, Artificial Sequence
  Description of Artificial Sequence: Synthetic peptide
TLAV

SEQ ID NO: 881 - protein, 7 aa, Artificial Sequence
  Description of Artificial Sequence: Synthetic peptide
SVSKPFL

SEQ ID NO: 882 - protein, 7 aa, Artificial Sequence
  Description of Artificial Sequence: Synthetic peptide
FTLTTPK

SEQ ID NO: 883 - protein, 7 aa, Artificial Sequence
  Description of Artificial Sequence: Synthetic peptide
MNATKNV

SEQ ID NO: 884 - protein, 7 aa, Artificial Sequence
  Description of Artificial Sequence: Synthetic peptide
QSSQTPR

SEQ ID NO: 885 - protein, 7 aa, Artificial Sequence
  Description of Artificial Sequence: Synthetic peptide
ILGTGTS

SEQ ID NO: 886 - protein, 7 aa, Artificial Sequence
  Description of Artificial Sequence: Synthetic peptide
TRTNPEA

SEQ ID NO: 887 - protein, 7 aa, Artificial Sequence
  Description of Artificial Sequence: Synthetic peptide
NGGTSSS

SEQ ID NO: 888 - protein, 7 aa, Artificial Sequence
  Description of Artificial Sequence: Synthetic peptide
YTLSQGW

SEQ ID NO: 889 - DNA, 21 bp, Artificial Sequence
  Description of Artificial Sequence: Synthetic oligonucleotide
aagtttcctgtggcgttgact

SEQ ID NO: 890 - DNA, 21 bp, Artificial Sequence
  Description of Artificial Sequence: Synthetic oligonucleotide
actttggcggtgccttttaag

SEQ ID NO: 891 - DNA, 21 bp, Artificial Sequence
  Description of Artificial Sequence: Synthetic oligonucleotide
agtgtgagtaagccttttttg

SEQ ID NO: 892 - DNA, 21 bp, Artificial Sequence
  Description of Artificial Sequence: Synthetic oligonucleotide
tttacgttgacgacgcctaag

SEQ ID NO: 893 - DNA, 21 bp, Artificial Sequence
  Description of Artificial Sequence: Synthetic oligonucleotide
atgaatgctacgaagaatgtg

SEQ ID NO: 894 - DNA, 21 bp, Artificial Sequence
  Description of Artificial Sequence: Synthetic oligonucleotide
cagtcgtcgcagacgcctagg

SEQ ID NO: 895 - DNA, 21 bp, Artificial Sequence
  Description of Artificial Sequence: Synthetic oligonucleotide
attctggggactggtacttcg

SEQ ID NO: 896 - DNA, 21 bp, Artificial Sequence
  Description of Artificial Sequence: Synthetic oligonucleotide
acgcggactaatcctgaggct

SEQ ID NO: 897 - DNA, 21 bp, Artificial Sequence
  Description of Artificial Sequence: Synthetic oligonucleotide
aatggggggactagtagttct

SEQ ID NO: 898 - DNA, 21 bp, Artificial Sequence
  Description of Artificial Sequence: Synthetic oligonucleotide
tatactttgtcgcagggttgg

SEQ ID NO: 899 - DNA, 609 bp, Unknown
  Description of Unknown: Internal ribosome entry site
aattccgcccctctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaacc

SEQ ID NO: 900 - DNA, 75 bp, Foot and mouth disease virus
  2A sequence
ggaagcggagtgaaacagactttgaattttgaccttctcaagttggcgggagacgtggagtccaaccctggacct

SEQ ID NO: 901 - DNA, 66 bp, Porcine teschovirus 1
  2A sequence
ggaagcggagctactaacttcagcctgctgaagcaggctggagacgtggaggagaaccctggacct

SEQ ID NO: 902 - DNA, 12 bp, Unknown
  Description of Unknown: Furin cleavage site
cgggccaagcgg

SEQ ID NO: 903 - DNA, 75 bp, Artificial Sequence
  Description of Artificial Sequence: Synthetic oligonucleotide
ggcggaggtggctccggaggcggaggcagcggcggaggtgggtctggcggaggcgggtgcggcggaggtggctcc

SEQ ID NO: 904 - protein, 8 aa, Unknown
  Description of Unknown: Linker sequence
LWSLDTTP

SEQ ID NO: 905 - protein, 4 aa, Unknown
  Description of Unknown: Linker sequence
MDGA

SEQ ID NO: 906 - protein, 4 aa, Unknown
  Description of Unknown: Linker sequence
QGNY

SEQ ID NO: 907 - protein, 4 aa, Unknown
  Description of Unknown: Linker sequence
RDGK

SEQ ID NO: 908 - protein, 5 aa, Unknown
  Description of Unknown: Linker sequence
DLNVG

SEQ ID NO: 909 - protein, 5 aa, Unknown
  Description of Unknown: Linker sequence
MATDE

SEQ ID NO: 910 - protein, 6 aa, Unknown
  Description of Unknown: Linker sequence
LTGSGA

SEQ ID NO: 911 - protein, 7 aa, Unknown
  Description of Unknown: Linker sequence
FAASGEL

SEQ ID NO: 912 - protein, 7 aa, Unknown
  Description of Unknown: Linker sequence
FNNREEQ

SEQ ID NO: 913 - protein, 7 aa, Unknown
  Description of Unknown: Linker sequence
GYMARNE

SEQ ID NO: 914 - protein, 7 aa, Unknown
  Description of Unknown: Linker sequence
VGTEHAK

SEQ ID NO: 915 - protein, 5 aa, Unknown
  Description of Unknown: Linker sequence
LNLDY

SEQ ID NO: 916 - protein, 14 aa, Unknown
  Description of Unknown: Linker sequence
KDGVIKGYYAYINP

SEQ ID NO: 917 - protein, 4 aa, Unknown
  Description of Unknown: Linker sequence
SKAQ

SEQ ID NO: 918 - protein, 6 aa, Unknown
  Description of Unknown: Linker sequence
LFNASA

SEQ ID NO: 919 - protein, 6 aa, Unknown
  Description of Unknown: Linker sequence
YQDGSV

SEQ ID NO: 920 - protein, 7 aa, Unknown
  Description of Unknown: Linker sequence
IHPQSVI

SEQ ID NO: 921 - protein, 5 aa, Unknown
  Description of Unknown: Linker sequence
KNPMD

SEQ ID NO: 922 - protein, 7 aa, Unknown
  Description of Unknown: Linker sequence
LGSEVPL

SEQ ID NO: 923 - protein, 14 aa, Unknown
  Description of Unknown: Linker sequence
LNVNNKVPNGATSM

SEQ ID NO: 924 - protein, 5 aa, Unknown
  Description of Unknown: Linker sequence
TTDDL

SEQ ID NO: 925 - protein, 6 aa, Unknown
  Description of Unknown: Linker sequence
AAGIRA

SEQ ID NO: 926 - protein, 6 aa, Unknown
  Description of Unknown: Linker sequence
QAGVDC

SEQ ID NO: 927 - protein, 6 aa, Unknown
  Description of Unknown: Linker sequence
YNPTDI

SEQ ID NO: 928 - protein, 8 aa, Unknown
  Description of Unknown: Linker sequence
EFLPRDTG

SEQ ID NO: 929 - protein, 9 aa, Unknown
  Description of Unknown: Linker sequence
GSGLPEQTD

SEQ ID NO: 930 - protein, 5 aa, Unknown
  Description of Unknown: Linker sequence
YSSNV

SEQ ID NO: 931 - protein, 6 aa, Unknown
  Description of Unknown: Linker sequence
KAGLNP

SEQ ID NO: 932 - protein, 6 aa, Unknown
  Description of Unknown: Linker sequence
KEEGKF

SEQ ID NO: 933 - protein, 6 aa, Unknown
  Description of Unknown: Linker sequence
VRGGIW

SEQ ID NO: 934 - protein, 9 aa, Unknown
  Description of Unknown: Linker sequence
QRYLKPENK

SEQ ID NO: 935 - protein, 6 aa, Unknown
  Description of Unknown: Linker sequence
EGVGEI

SEQ ID NO: 936 - protein, 8 aa, Unknown
  Description of Unknown: Linker sequence
PVDPPEKW

SEQ ID NO: 937 - protein, 9 aa, Unknown
  Description of Unknown: Linker sequence
AHPGVSIPT

SEQ ID NO: 938 - protein, 15 aa, Unknown
  Description of Unknown: Linker sequence
FKDPELPRNTPKRSI

SEQ ID NO: 939 - protein, 14 aa, Unknown
  Description of Unknown: Linker sequence
YLEGVERNPVGAGL

SEQ ID NO: 940 - protein, 5 aa, Unknown
  Description of Unknown: Linker sequence
CPRCP

SEQ ID NO: 941 - protein, 7 aa, Unknown
  Description of Unknown: Linker sequence
APPVAGP

SEQ ID NO: 942 - protein, 8 aa, Unknown
  Description of Unknown: Linker sequence
APELLGGP

SEQ ID NO: 943 - protein, 9 aa, Unknown
  Description of Unknown: Linker sequence
CCVECPPCP

SEQ ID NO: 944 - protein, 12 aa, Unknown
  Description of Unknown: Linker sequence
ELKTPLGDTTHT

SEQ ID NO: 945 - protein, 6 aa, Unknown
  Description of Unknown: Linker sequence
HNVDDV

SEQ ID NO: 946 - protein, 6 aa, Unknown
  Description of Unknown: Linker sequence
AGQKDE

SEQ ID NO: 947 - protein, 9 aa, Unknown
  Description of Unknown: Linker sequence
KLNLPILPT

SEQ ID NO: 948 - protein, 9 aa, Unknown
  Description of Unknown: Linker sequence
SSPRVTNEG

SEQ ID NO: 949 - protein, 17 aa, Unknown
  Description of Unknown: Linker sequence
KAAAALKGSDHRRATNV

SEQ ID NO: 950 - protein, 4 aa, Unknown
  Description of Unknown: Linker sequence
KKRV

SEQ ID NO: 951 - protein, 5 aa, Unknown
  Description of Unknown: Linker sequence
QLEVK

SEQ ID NO: 952 - protein, 5 aa, Unknown
  Description of Unknown: Linker sequence
TNGRL

SEQ ID NO: 953 - protein, 10 aa, Unknown
  Description of Unknown: Linker sequence
LYTPEIAENQ

SEQ ID NO: 954 - protein, 4 aa, Unknown
  Description of Unknown: Linker sequence
NSEY

SEQ ID NO: 955 - protein, 5 aa, Unknown
  Description of Unknown: Linker sequence
SMKDF

SEQ ID NO: 956 - protein, 12 aa, Unknown
  Description of Unknown: Linker sequence
KDRWQERHILRP

SEQ ID NO: 957 - protein, 14 aa, Unknown
  Description of Unknown: Linker sequence
DDPEGPVMPGSHSV

SEQ ID NO: 958 - protein, 23 aa, Unknown
  Description of Unknown: Linker sequence
LCPSNPTCIYKYGDESSNSLPGH

SEQ ID NO: 959 - protein, 35 aa, Unknown
  Description of Unknown: Linker sequence
LCEALQHNLPPFTPPPHTEDSVYPMPRVIFRMFDY

SEQ ID NO: 960 - protein, 5 aa, Unknown
  Description of Unknown: Linker sequence
NMVTC

SEQ ID NO: 961 - protein, 10 aa, Unknown
  Description of Unknown: Linker sequence
NLEEHLGKLN

SEQ ID NO: 962 - protein, 4 aa, Unknown
  Description of Unknown: Linker sequence
QGAH

SEQ ID NO: 963 - protein, 6 aa, Unknown
  Description of Unknown: Linker sequence
QRIPLY

SEQ ID NO: 964 - protein, 8 aa, Unknown
  Description of Unknown: Linker sequence
QRKPLFYI

SEQ ID NO: 965 - protein, 4 aa, Unknown
  Description of Unknown: Linker sequence
AGGR

SEQ ID NO: 966 - protein, 6 aa, Unknown
  Description of Unknown: Linker sequence
YPYKGE

SEQ ID NO: 967 - protein, 7 aa, Unknown
  Description of Unknown: Linker sequence
NHETGEL

SEQ ID NO: 968 - protein, 8 aa, Unknown
  Description of Unknown: Linker sequence
TFELKTDV

SEQ ID NO: 969 - protein, 25 aa, Unknown
  Description of Unknown: Linker sequence
ALGLPHSDVFRQAKDVAESDRGFSL

SEQ ID NO: 970 - protein, 4 aa, Unknown
  Description of Unknown: Linker sequence
LKDW

SEQ ID NO: 971 - protein, 4 aa, Unknown
  Description of Unknown: Linker sequence
WTGM

SEQ ID NO: 972 - protein, 4 aa, Unknown
  Description of Unknown: Linker sequence
YNGL

SEQ ID NO: 973 - protein, 5 aa, Unknown
  Description of Unknown: Linker sequence
DRPGE

SEQ ID NO: 974 - protein, 5 aa, Unknown
  Description of Unknown: Linker sequence
LGVSI

SEQ ID NO: 975 - protein, 5 aa, Unknown
  Description of Unknown: Linker sequence
RSTGR

SEQ ID NO: 976 - protein, 5 aa, Unknown
  Description of Unknown: Linker sequence
YRMLP

SEQ ID NO: 977 - protein, 5 aa, Unknown
  Description of Unknown: Linker sequence
YVNDF

SEQ ID NO: 978 - protein, 6 aa, Unknown
  Description of Unknown: Linker sequence
EYGSPR

SEQ ID NO: 979 - protein, 6 aa, Unknown
  Description of Unknown: Linker sequence
IDRGRV

SEQ ID NO: 980 - protein, 7 aa, Unknown
  Description of Unknown: Linker sequence
RAADGQM

SEQ ID NO: 981 - protein, 7 aa, Unknown
  Description of Unknown: Linker sequence
TKEKNNV

SEQ ID NO: 982 - protein, 8 aa, Unknown
  Description of Unknown: Linker sequence
DQAGLGHE

SEQ ID NO: 983 - protein, 8 aa, Unknown
  Description of Unknown: Linker sequence
FSQIKDAM

SEQ ID NO: 984 - protein, 8 aa, Unknown
  Description of Unknown: Linker sequence
QAAPGKST

SEQ ID NO: 985 - protein, 8 aa, Unknown
  Description of Unknown: Linker sequence
QLPAGATQ

SEQ ID NO: 986 - protein, 9 aa, Unknown
  Description of Unknown: Linker sequence
AAKHPDMLT

SEQ ID NO: 987 - protein, 9 aa, Unknown
  Description of Unknown: Linker sequence
LASKLPTGV

SEQ ID NO: 988 - protein, 9 aa, Unknown
  Description of Unknown: Linker sequence
PNGLEDTPQ

SEQ ID NO: 989 - protein, 9 aa, Unknown
  Description of Unknown: Linker sequence
QERLSGNQA

SEQ ID NO: 990 - protein, 12 aa, Unknown
  Description of Unknown: Linker sequence
NGFGFAGRGQNT

SEQ ID NO: 991 - protein, 14 aa, Unknown
  Description of Unknown: Linker sequence
RLPSSFLPDEDQGV

SEQ ID NO: 992 - protein, 15 aa, Unknown
  Description of Unknown: Linker sequence
FNLPAIVELGTATGF

SEQ ID NO: 993 - protein, 17 aa, Unknown
  Description of Unknown: Linker sequence
MLKPIAKGDHGEGKKGF

SEQ ID NO: 994 - protein, 7 aa, Unknown
  Description of Unknown: Linker sequence
LAHLLPP

SEQ ID NO: 995 - protein, 9 aa, Unknown
  Description of Unknown: Linker sequence
QAPEAGFEH

SEQ ID NO: 996 - protein, 10 aa, Unknown
  Description of Unknown: Linker sequence
KDKFICDRPL

SEQ ID NO: 997 - protein, 16 aa, Unknown
  Description of Unknown: Linker sequence
PVEFHNPLKGHVAEPH

SEQ ID NO: 998 - protein, 16 aa, Unknown
  Description of Unknown: Linker sequence
QKTMPSAPAPDGLPSE

SEQ ID NO: 999 - protein, 4 aa, Unknown
  Description of Unknown: Linker sequence
AGRV

SEQ ID NO: 1000 - protein, 6 aa, Unknown
  Description of Unknown: Linker sequence
AGHGFA

SEQ ID NO: 1001 - protein, 10 aa, Unknown
  Description of Unknown: Linker sequence
LPPGPGPFPG

SEQ ID NO: 1002 - protein, 11 aa, Unknown
  Description of Unknown: Linker sequence
IFGIGGGLLEY

SEQ ID NO: 1003 - protein, 15 aa, Unknown
  Description of Unknown: Linker sequence
AYYNFEDLPNNMDNI

SEQ ID NO: 1004 - protein, 10 aa, Unknown
  Description of Unknown: Linker sequence
MICTRSKPKC

SEQ ID NO: 1005 - protein, 6 aa, Unknown
  Description of Unknown: Linker sequence
QSSLDL

SEQ ID NO: 1006 - protein, 6 aa, Unknown
  Description of Unknown: Linker sequence
IPDGDE

SEQ ID NO: 1007 - protein, 15 aa, Unknown
  Description of Unknown: Linker sequence
PTNPVTGEIPTLSAL

SEQ ID NO: 1008 - protein, 9 aa, Unknown
  Description of Unknown: Linker sequence
GGPCRADIK

SEQ ID NO: 1009 - protein, 11 aa, Unknown
  Description of Unknown: Linker sequence
SGACSTDKPCG

SEQ ID NO: 1010 - protein, 11 aa, Unknown
  Description of Unknown: Linker sequence
EGSKTVPIADK

SEQ ID NO: 1011 - protein, 7 aa, Unknown
  Description of Unknown: Linker sequence
INGKKPE

SEQ ID NO: 1012 - protein, 8 aa, Unknown
  Description of Unknown: Linker sequence
ELPAYMSG

SEQ ID NO: 1013 - protein, 8 aa, Unknown
  Description of Unknown: Linker sequence
VTGTLDYG

SEQ ID NO: 1014 - protein, 15 aa, Unknown
  Description of Unknown: Linker sequence
AAEDAIEIHPGTPNV

SEQ ID NO: 1015 - protein, 21 aa, Unknown
  Description of Unknown: Linker sequence
LEFKMPADGRIWGSKYPRPTA

SEQ ID NO: 1016 - protein, 5 aa, Unknown
  Description of Unknown: Linker sequence
SDYDV

SEQ ID NO: 1017 - protein, 5 aa, Unknown
  Description of Unknown: Linker sequence
VGSGP

SEQ ID NO: 1018 - protein, 6 aa, Unknown
  Description of Unknown: Linker sequence
IDSQSA

SEQ ID NO: 1019 - protein, 6 aa, Unknown
  Description of Unknown: Linker sequence
NKRDAY

SEQ ID NO: 1020 - protein, 6 aa, Unknown
  Description of Unknown: Linker sequence
RKGIRT

SEQ ID NO: 1021 - protein, 7 aa, Unknown
  Description of Unknown: Linker sequence
MGERFGG

SEQ ID NO: 1022 - protein, 8 aa, Unknown
  Description of Unknown: Linker sequence
VDTGAEKR

SEQ ID NO: 1023 - protein, 10 aa, Unknown
  Description of Unknown: Linker sequence
TGGHPSKEAQ

SEQ ID NO: 1024 - protein, 10 aa, Unknown
  Description of Unknown: Linker sequence
VPAATEGGLH

SEQ ID NO: 1025 - protein, 18 aa, Unknown
  Description of Unknown: Linker sequence
VLDTVDIENYISVPKTEG

SEQ ID NO: 1026 - protein, 5 aa, Unknown
  Description of Unknown: Linker sequence
DLAYV

SEQ ID NO: 1027 - protein, 13 aa, Unknown
  Description of Unknown: Linker sequence
VVPPELKTKDHII

SEQ ID NO: 1028 - protein, 5 aa, Unknown
  Description of Unknown: Linker sequence
WKQHK

SEQ ID NO: 1029 - protein, 7 aa, Unknown
  Description of Unknown: Linker sequence
KIQGCSA

SEQ ID NO: 1030 - protein, 8 aa, Unknown
  Description of Unknown: Linker sequence
DVASGDGL

SEQ ID NO: 1031 - protein, 20 aa, Unknown
  Description of Unknown: Linker sequence
VSPWHRMSYFFNPVSNFISF

SEQ ID NO: 1032 - protein, 5 aa, Unknown
  Description of Unknown: Linker sequence
YDNDE

SEQ ID NO: 1033 - protein, 10 aa, Unknown
  Description of Unknown: Linker sequence
RNGDSRRPGL

SEQ ID NO: 1034 - protein, 4 aa, Unknown
  Description of Unknown: Linker sequence
VEET

SEQ ID NO: 1035 - protein, 6 aa, Unknown
  Description of Unknown: Linker sequence
AIQDIS

SEQ ID NO: 1036 - protein, 6 aa, Unknown
  Description of Unknown: Linker sequence
KLPITL

SEQ ID NO: 1037 - protein, 11 aa, Unknown
  Description of Unknown: Linker sequence
ADSAYITYAND

SEQ ID NO: 1038 - protein, 4 aa, Unknown
  Description of Unknown: Linker sequence
FGGV

SEQ ID NO: 1039 - protein, 4 aa, Unknown
  Description of Unknown: Linker sequence
YGIK

SEQ ID NO: 1040 - protein, 5 aa, Unknown
  Description of Unknown: Linker sequence
INFNS

SEQ ID NO: 1041 - protein, 5 aa, Unknown
  Description of Unknown: Linker sequence
YGRDH

SEQ ID NO: 1042 - protein, 6 aa, Unknown
  Description of Unknown: Linker sequence
GMSRTN

SEQ ID NO: 1043 - protein, 7 aa, Unknown
  Description of Unknown: Linker sequence
ASLGING

SEQ ID NO: 1044 - protein, 7 aa, Unknown
  Description of Unknown: Linker sequence
SAPRLQH

SEQ ID NO: 1045 - protein, 7 aa, Unknown
  Description of Unknown: Linker sequence
YIPDFGG

SEQ ID NO: 1046 - protein, 8 aa, Unknown
  Description of Unknown: Linker sequence
SLPNYLAP

SEQ ID NO: 1047 - protein, 9 aa, Unknown
  Description of Unknown: Linker sequence
LDGKFADNV

SEQ ID NO: 1048 - protein, 9 aa, Unknown
  Description of Unknown: Linker sequence
VINNVNADP

SEQ ID NO: 1049 - protein, 10 aa, Unknown
  Description of Unknown: Linker sequence
QTQHALEKLS

SEQ ID NO: 1050 - protein, 11 aa, Unknown
  Description of Unknown: Linker sequence
EGKVFKTRHTG

SEQ ID NO: 1051 - protein, 11 aa, Unknown
  Description of Unknown: Linker sequence
VKADSEGQPGP

SEQ ID NO: 1052 - protein, 12 aa, Unknown
  Description of Unknown: Linker sequence
RAFVYHPDIEDR

SEQ ID NO: 1053 - protein, 13 aa, Unknown
  Description of Unknown: Linker sequence
AFGDVDTADPLDP

SEQ ID NO: 1054 - protein, 13 aa, Unknown
  Description of Unknown: Linker sequence
LKTETHARGEGST

SEQ ID NO: 1055 - protein, 16 aa, Unknown
  Description of Unknown: Linker sequence
KNGPIDFQPREPFSAL

SEQ ID NO: 1056 - protein, 16 aa, Unknown
  Description of Unknown: Linker sequence
VINPGTDRNWTGHPFV

SEQ ID NO: 1057 - protein, 17 aa, Unknown
  Description of Unknown: Linker sequence
QITQEYFGFATHLAYQG

SEQ ID NO: 1058 - protein, 22 aa, Unknown
  Description of Unknown: Linker sequence
NHWDNLNRVVERGYAGLSLWDW

SEQ ID NO: 1059 - protein, 15 aa, Unknown
  Description of Unknown: Linker sequence
VGSLVSGPSFTSGEV

SEQ ID NO: 1060 - protein, 13 aa, Unknown
  Description of Unknown: Linker sequence
ITSQETDGWYTLA

SEQ ID NO: 1061 - protein, 21 aa, Unknown
  Description of Unknown: Linker sequence
RNKEGQDVNEQGQPIRGRTQD

SEQ ID NO: 1062 - protein, 5 aa, Unknown
  Description of Unknown: Linker sequence
HFQPF

SEQ ID NO: 1063 - protein, 5 aa, Unknown
  Description of Unknown: Linker sequence
TGTPV

SEQ ID NO: 1064 - protein, 7 aa, Unknown
  Description of Unknown: Linker sequence
PLSHFDA

SEQ ID NO: 1065 - protein, 4 aa, Unknown
  Description of Unknown: Linker sequence
FNPI

SEQ ID NO: 1066 - protein, 4 aa, Unknown
  Description of Unknown: Linker sequence
KNGS

SEQ ID NO: 1067 - protein, 5 aa, Unknown
  Description of Unknown: Linker sequence
DRFQG

SEQ ID NO: 1068 - protein, 5 aa, Unknown
  Description of Unknown: Linker sequence
EVPDI

SEQ ID NO: 1069 - protein, 6 aa, Unknown
  Description of Unknown: Linker sequence
ACELHT

SEQ ID NO: 1070 - protein, 6 aa, Unknown
  Description of Unknown: Linker sequence
LPATLT

SEQ ID NO: 1071 - protein, 6 aa, Unknown
  Description of Unknown: Linker sequence
LPDPYG

SEQ ID NO: 1072 - protein, 6 aa, Unknown
  Description of Unknown: Linker sequence
LPHAQP

SEQ ID NO: 1073 - protein, 6 aa, Unknown
  Description of Unknown: Linker sequence
RQQASF

SEQ ID NO: 1074 - protein, 6 aa, Unknown
  Description of Unknown: Linker sequence
YIGGNL

SEQ ID NO: 1075 - protein, 7 aa, Unknown
  Description of Unknown: Linker sequence
FGRTCKE

SEQ ID NO: 1076 - protein, 7 aa, Unknown
  Description of Unknown: Linker sequence
VDKGDNV

SEQ ID NO: 1077 - protein, 7 aa, Unknown
  Description of Unknown: Linker sequence
WGPECNH

SEQ ID NO: 1078 - protein, 8 aa, Unknown
  Description of Unknown: Linker sequence
VRRCEAQK

SEQ ID NO: 1079 - protein, 9 aa, Unknown
  Description of Unknown: Linker sequence
KVLIKEEDA

SEQ ID NO: 1080 - protein, 9 aa, Unknown
  Description of Unknown: Linker sequence
SCATGWKGL

SEQ ID NO: 1081 - protein, 10 aa, Unknown
  Description of Unknown: Linker sequence
IVDLPDHIEV

SEQ ID NO: 1082 - protein, 10 aa, Unknown
  Description of Unknown: Linker sequence
LCTACMNNGV

SEQ ID NO: 1083 - protein, 13 aa, Unknown
  Description of Unknown: Linker sequence
RCSGQEGCKSYVF

SEQ ID NO: 1084 - protein, 22 aa, Unknown
  Description of Unknown: Linker sequence
LCSPGWQGLQCEREGIPRMTPK

SEQ ID NO: 1085 - protein, 25 aa, Unknown
  Description of Unknown: Linker sequence
CNEACHPGFYGPDCKLRCSCNNGEM

SEQ ID NO: 1086 - protein, 4 aa, Unknown
  Description of Unknown: Linker sequence
LKTP

SEQ ID NO: 1087 - protein, 14 aa, Unknown
  Description of Unknown: Linker sequence
AKGRRAEDGSVIDY

SEQ ID NO: 1088 - protein, 12 aa, Unknown
  Description of Unknown: Linker sequence
AARPLRVHRRPL

SEQ ID NO: 1089 - protein, 4 aa, Unknown
  Description of Unknown: Linker sequence
LIPL

SEQ ID NO: 1090 - protein, 5 aa, Unknown
  Description of Unknown: Linker sequence
FGEGA

SEQ ID NO: 1091 - protein, 6 aa, Unknown
  Description of Unknown: Linker sequence
AFDDAK

SEQ ID NO: 1092 - protein, 6 aa, Unknown
  Description of Unknown: Linker sequence
KVNGKR

SEQ ID NO: 1093 - protein, 7 aa, Unknown
  Description of Unknown: Linker sequence
LSKTGMP

SEQ ID NO: 1094 - protein, 8 aa, Unknown
  Description of Unknown: Linker sequence
VLPYPRMR

SEQ ID NO: 1095 - protein, 8 aa, Unknown
  Description of Unknown: Linker sequence
VRADDGLL

SEQ ID NO: 1096 - protein, 16 aa, Unknown
  Description of Unknown: Linker sequence
EAEDDFKIEKPTKEDA

SEQ ID NO: 1097 - protein, 5 aa, Unknown
  Description of Unknown: Linker sequence
IRFGR

SEQ ID NO: 1098 - protein, 6 aa, Unknown
  Description of Unknown: Linker sequence
QTETHV

SEQ ID NO: 1099 - protein, 13 aa, Unknown
  Description of Unknown: Linker sequence
PLKGRYTPSVGDV

SEQ ID NO: 1100 - protein, 7 aa, Unknown
  Description of Unknown: Linker sequence
KNPALSD

SEQ ID NO: 1101 - protein, 12 aa, Unknown
  Description of Unknown: Linker sequence
RFGSSEIGKGKK

SEQ ID NO: 1102 - protein, 14 aa, Unknown
  Description of Unknown: Linker sequence
GKFSGRKGTWVGFT

SEQ ID NO: 1103 - protein, 9 aa, Unknown
  Description of Unknown: Linker sequence
QFFMSDKPL

SEQ ID NO: 1104 - protein, 11 aa, Unknown
  Description of Unknown: Linker sequence
HAPRDMGPQPR

SEQ ID NO: 1105 - protein, 12 aa, Unknown
  Description of Unknown: Linker sequence
HFKPAPWNGLPA

SEQ ID NO: 1106 - protein, 6 aa, Unknown
  Description of Unknown: Linker sequence
ATKASK

SEQ ID NO: 1107 - protein, 7 aa, Unknown
  Description of Unknown: Linker sequence
ATKGATK

SEQ ID NO: 1108 - protein, 7 aa, Unknown
  Description of Unknown: Linker sequence
IAKAFKN

SEQ ID NO: 1109 - protein, 14 aa, Unknown
  Description of Unknown: Linker sequence
VRGSPAINVAVHVF

SEQ ID NO: 1110 - protein, 18 aa, Unknown
  Description of Unknown: Linker sequence
GSTSGSGKPGSGEGSTKG

SEQ ID NO: 1111 - protein, 18 aa, Unknown
  Description of Unknown: Linker sequence
KESGSVSSEQLAQFRSLD

SEQ ID NO: 1112 - protein, 6 aa, Unknown
  Description of Unknown: Linker sequence
LDPPKQ

SEQ ID NO: 1113 - protein, 6 aa, Unknown
  Description of Unknown: Linker sequence
TATADD

SEQ ID NO: 1114 - protein, 7 aa, Unknown
  Description of Unknown: Linker sequence
AEAQTCR

SEQ ID NO: 1115 - protein, 7 aa, Unknown
  Description of Unknown: Linker sequence
EEKPQGQ

SEQ ID NO: 1116 - protein, 7 aa, Unknown
  Description of Unknown: Linker sequence
LGLNDPL

SEQ ID NO: 1117 - protein, 7 aa, Unknown
  Description of Unknown: Linker sequence
RFPTLPF

SEQ ID NO: 1118 - protein, 9 aa, Unknown
  Description of Unknown: Linker sequence
ISSFDRPNI

SEQ ID NO: 1119 - protein, 13 aa, Unknown
  Description of Unknown: Linker sequence
YFGEGRQEPCGNC

SEQ ID NO: 1120 - protein, 7 aa, Unknown
  Description of Unknown: Linker sequence
LGLNRKW

SEQ ID NO: 1121 - protein, 12 aa, Unknown
  Description of Unknown: Linker sequence
YFGSYGTRGVGY

SEQ ID NO: 1122 - protein, 4 aa, Unknown
  Description of Unknown: Linker sequence
NIKG

SEQ ID NO: 1123 - protein, 5 aa, Unknown
  Description of Unknown: Linker sequence
NPVPQ

SEQ ID NO: 1124 - protein, 6 aa, Unknown
  Description of Unknown: Linker sequence
AKFPAD

SEQ ID NO: 1125 - protein, 6 aa, Unknown
  Description of Unknown: Linker sequence
IQNVDF

SEQ ID NO: 1126 - protein, 6 aa, Unknown
  Description of Unknown: Linker sequence
LTGQMV

SEQ ID NO: 1127 - protein, 8 aa, Unknown
  Description of Unknown: Linker sequence
AAEDARQY

SEQ ID NO: 1128 - protein, 16 aa, Unknown
  Description of Unknown: Linker sequence
KLDGSQTSKWLSSEPL

SEQ ID NO: 1129 - protein, 4 aa, Unknown
  Description of Unknown: Linker sequence
DIFK

SEQ ID NO: 1130 - protein, 4 aa, Unknown
  Description of Unknown: Linker sequence
LPGM

SEQ ID NO: 1131 - protein, 6 aa, Unknown
  Description of Unknown: Linker sequence
IPGNGG

SEQ ID NO: 1132 - protein, 6 aa, Unknown
  Description of Unknown: Linker sequence
VEDWVE

SEQ ID NO: 1133 - protein, 15 aa, Unknown
  Description of Unknown: Linker sequence
RLKADETYTSPEDYF

SEQ ID NO: 1134 - protein, 5 aa, Unknown
  Description of Unknown: Linker sequence
RKPTE

SEQ ID NO: 1135 - protein, 6 aa, Unknown
  Description of Unknown: Linker sequence
YARTIV

SEQ ID NO: 1136 - protein, 4 aa, Unknown
  Description of Unknown: Linker sequence
REDG

SEQ ID NO: 1137 - protein, 4 aa, Unknown
  Description of Unknown: Linker sequence
YKTL

SEQ ID NO: 1138 - protein, 6 aa, Unknown
  Description of Unknown: Linker sequence
DRAKRI

SEQ ID NO: 1139 - protein, 11 aa, Unknown
  Description of Unknown: Linker sequence
KAPQTEPPASI

SEQ ID NO: 1140 - protein, 21 aa, Unknown
  Description of Unknown: Linker sequence
AAQSDRPAHAQGVPLTRIERT

SEQ ID NO: 1141 - protein, 8 aa, Unknown
  Description of Unknown: Linker sequence
DWDKDADP

SEQ ID NO: 1142 - protein, 14 aa, Unknown
  Description of Unknown: Linker sequence
LFDRHVSSSVRLND

SEQ ID NO: 1143 - protein, 26 aa, Unknown
  Description of Unknown: Linker sequence
LVEESSRQLPTAAPEPAKVDQDAGRL

SEQ ID NO: 1144 - protein, 6 aa, Unknown
  Description of Unknown: Linker sequence
LLGVTP

SEQ ID NO: 1145 - protein, 4 aa, Unknown
  Description of Unknown: Linker sequence
DTLP

SEQ ID NO: 1146 - protein, 4 aa, Unknown
  Description of Unknown: Linker sequence
ENGL

SEQ ID NO: 1147 - protein, 4 aa, Unknown
  Description of Unknown: Linker sequence
FREV

SEQ ID NO: 1148 - protein, 4 aa, Unknown
  Description of Unknown: Linker sequence
KVSP

SEQ ID NO: 1149 - protein, 4 aa, Unknown
  Description of Unknown: Linker sequence
LDGK

SEQ ID NO: 1150 - protein, 4 aa, Unknown
  Description of Unknown: Linker sequence
LNGK

SEQ ID NO: 1151 - protein, 4 aa, Unknown
  Description of Unknown: Linker sequence
PLLI

SEQ ID NO: 1152 - protein, 4 aa, Unknown
  Description of Unknown: Linker sequence
SGQT

SEQ ID NO: 1153 - protein, 5 aa, Unknown
  Description of Unknown: Linker sequence
KNPRG

SEQ ID NO: 1154 - protein, 5 aa, Unknown
  Description of Unknown: Linker sequence
KPTTQ

SEQ ID NO: 1155 - protein, 5 aa, Unknown
  Description of Unknown: Linker sequence
SLKWK

SEQ ID NO: 1156 - protein, 5 aa, Unknown
  Description of Unknown: Linker sequence
TSEMD

SEQ ID NO: 1157 - protein, 6 aa, Unknown
  Description of Unknown: Linker sequence
LSGQEA

SEQ ID NO: 1158 - protein, 9 aa, Unknown
  Description of Unknown: Linker sequence
PLDVAPQGK

SEQ ID NO: 1159 - protein, 11 aa, Unknown
  Description of Unknown: Linker sequence
AKNTYDDSAWT

SEQ ID NO: 1160 - protein, 12 aa, Unknown
  Description of Unknown: Linker sequence
ELPELPQPESAG

SEQ ID NO: 1161 - protein, 12 aa, Unknown
  Description of Unknown: Linker sequence
QPNATAWSEAGH

SEQ ID NO: 1162 - protein, 12 aa, Unknown
  Description of Unknown: Linker sequence
SEYLFRHSDNEL

SEQ ID NO: 1163 - protein, 13 aa, Unknown
  Description of Unknown: Linker sequence
VAYTAPKVQLPSL

SEQ ID NO: 1164 - protein, 15 aa, Unknown
  Description of Unknown: Linker sequence
NLSVTLPAASHAIPH

SEQ ID NO: 1165 - protein, 16 aa, Unknown
  Description of Unknown: Linker sequence
IDNMGLDEDWTIGSED

SEQ ID NO: 1166 - protein, 23 aa, Unknown
  Description of Unknown: Linker sequence
TGNLGGENYRDTVRGPLNEGGLY

SEQ ID NO: 1167 - protein, 10 aa, Unknown
  Description of Unknown: Linker sequence
SNADLQTLPA

SEQ ID NO: 1168 - protein, 11 aa, Unknown
  Description of Unknown: Linker sequence
LRGKIVPTPMQ

SEQ ID NO: 1169 - protein, 12 aa, Unknown
  Description of Unknown: Linker sequence
KGGVAYRLPVPG

SEQ ID NO: 1170 - protein, 11 aa, Unknown
  Description of Unknown: Linker sequence
QAWATAPYAPT

SEQ ID NO: 1171 - protein, 7 aa, Unknown
  Description of Unknown: Linker sequence
YSKGVSQ

SEQ ID NO: 1172 - protein, 6 aa, Unknown
  Description of Unknown: Linker sequence
QKGRVL

SEQ ID NO: 1173 - protein, 6 aa, Unknown
  Description of Unknown: Linker sequence
VLGKEL

SEQ ID NO: 1174 - protein, 4 aa, Unknown
  Description of Unknown: Linker sequence
ANTP

SEQ ID NO: 1175 - protein, 4 aa, Unknown
  Description of Unknown: Linker sequence
DAPT

SEQ ID NO: 1176 - protein, 5 aa, Unknown
  Description of Unknown: Linker sequence
LDPIK

SEQ ID NO: 1177 - protein, 5 aa, Unknown
  Description of Unknown: Linker sequence
TTDFQ

SEQ ID NO: 1178 - protein, 6 aa, Unknown
  Description of Unknown: Linker sequence
PWNKEV

SEQ ID NO: 1179 - protein, 6 aa, Unknown
  Description of Unknown: Linker sequence
QQLLPP

SEQ ID NO: 1180 - protein, 8 aa, Unknown
  Description of Unknown: Linker sequence
TDPQTGKT

SEQ ID NO: 1181 - protein, 9 aa, Unknown
  Description of Unknown: Linker sequence
GRHGIVPTR

SEQ ID NO: 1182 - protein, 9 aa, Unknown
  Description of Unknown: Linker sequence
TADGSWFFK

SEQ ID NO: 1183 - protein, 12 aa, Unknown
  Description of Unknown: Linker sequence
LFSMGVTRGKWG

SEQ ID NO: 1184 - protein, 18 aa, Unknown
  Description of Unknown: Linker sequence
LAPGMGEDGELEETGVPA

SEQ ID NO: 1185 - protein, 21 aa, Unknown
  Description of Unknown: Linker sequence
CWVMHPGESWHGFKDIPDNWS

SEQ ID NO: 1186 - protein, 7 aa, Unknown
  Description of Unknown: Linker sequence
EVHVRGH

SEQ ID NO: 1187 - protein, 17 aa, Unknown
  Description of Unknown: Linker sequence
VGDPGPICRPWECCDKA

SEQ ID NO: 1188 - protein, 7 aa, Unknown
  Description of Unknown: Linker sequence
KYEIPEG

SEQ ID NO: 1189 - protein, 7 aa, Unknown
  Description of Unknown: Linker sequence
RKVCEQE

SEQ ID NO: 1190 - protein, 12 aa, Unknown
  Description of Unknown: Linker sequence
EQLLPKLFDGCY

SEQ ID NO: 1191 - protein, 5 aa, Unknown
  Description of Unknown: Linker sequence
SLHFS

SEQ ID NO: 1192 - protein, 6 aa, Unknown
  Description of Unknown: Linker sequence
VYPLQW

SEQ ID NO: 1193 - protein, 7 aa, Unknown
  Description of Unknown: Linker sequence
KTVSGLY

SEQ ID NO: 1194 - protein, 12 aa, Unknown
  Description of Unknown: Linker sequence
SDPAFQPPCSEV

SEQ ID NO: 1195 - protein, 13 aa, Unknown
  Description of Unknown: Linker sequence
SVVKPIGLAPLVY

SEQ ID NO: 1196 - protein, 30 aa, Unknown
  Description of Unknown: Linker sequence
ARWHSRLGFFRDPRPFPLPLSSLFSDGGNV

SEQ ID NO: 1197 - protein, 15 aa, Unknown
  Description of Unknown: Linker sequence
ELRSLTRHPKYKTEL

SEQ ID NO: 1198 - protein, 7 aa, Unknown
  Description of Unknown: Linker sequence
VYNTFCI

SEQ ID NO: 1199 - protein, 4 aa, Unknown
  Description of Unknown: Linker sequence
AATM

SEQ ID NO: 1200 - protein, 4 aa, Unknown
  Description of Unknown: Linker sequence
FAGT

SEQ ID NO: 1201 - protein, 4 aa, Unknown
  Description of Unknown: Linker sequence
RGDF

SEQ ID NO: 1202 - protein, 4 aa, Unknown
  Description of Unknown: Linker sequence
SNPW

SEQ ID NO: 1203 - protein, 4 aa, Unknown
  Description of Unknown: Linker sequence
SPDK

SEQ ID NO: 1204 - protein, 7 aa, Unknown
  Description of Unknown: Linker sequence
KTADQQD

SEQ ID NO: 1205 - protein, 8 aa, Unknown
  Description of Unknown: Linker sequence
QGAGAVDA

SEQ ID NO: 1206 - protein, 9 aa, Unknown
  Description of Unknown: Linker sequence
AKQDDDSHY

SEQ ID NO: 1207 - protein, 9 aa, Unknown
  Description of Unknown: Linker sequence
DKDNTSSKV

SEQ ID NO: 1208 - protein, 9 aa, Unknown
  Description of Unknown: Linker sequence
NLSALEKPI

SEQ ID NO: 1209 - protein, 11 aa, Unknown
  Description of Unknown: Linker sequence
IHRHANGKPYA

SEQ ID NO: 1210 - protein, 16 aa, Unknown
  Description of Unknown: Linker sequence
EGVENIEDIESSEITE

SEQ ID NO: 1211 - protein, 36 aa, Unknown
  Description of Unknown: Linker sequence
DSKDGSSYYHEANSDAKDQLDGDGLQFYALKNNFTA

SEQ ID NO: 1212 - protein, 9 aa, Unknown
  Description of Unknown: Linker sequence
GSIQGQDLS

SEQ ID NO: 1213 - protein, 4 aa, Unknown
  Description of Unknown: Linker sequence
RFDT

SEQ ID NO: 1214 - protein, 15 aa, Unknown
  Description of Unknown: Linker sequence
TLTTPASNQLLALPR

SEQ ID NO: 1215 - protein, 4 aa, Unknown
  Description of Unknown: Linker sequence
ELPF

SEQ ID NO: 1216 - protein, 7 aa, Unknown
  Description of Unknown: Linker sequence
AGDNPDA

SEQ ID NO: 1217 - protein, 7 aa, Unknown
  Description of Unknown: Linker sequence
VTTAEAY

SEQ ID NO: 1218 - protein, 11 aa, Unknown
  Description of Unknown: Linker sequence
AFPGLNGMDLA

SEQ ID NO: 1219 - protein, 18 aa, Unknown
  Description of Unknown: Linker sequence
WTQGSWTLTGGLPQAKKE

SEQ ID NO: 1220 - protein, 16 aa, Unknown
  Description of Unknown: Linker sequence
RGIKLTKIKLDLPINF

SEQ ID NO: 1221 - protein, 4 aa, Unknown
  Description of Unknown: Linker sequence
FLDV

SEQ ID NO: 1222 - protein, 5 aa, Unknown
  Description of Unknown: Linker sequence
QTSLS

SEQ ID NO: 1223 - protein, 26 aa, Unknown
  Description of Unknown: Linker sequence
YTGKWGLNDVNPEAWPRDLKGMAAVR

SEQ ID NO: 1224 - protein, 17 aa, Unknown
  Description of Unknown: Linker sequence
VKEGAGQPDFCDGHSPA

SEQ ID NO: 1225 - protein, 9 aa, Unknown
  Description of Unknown: Linker sequence
VDGSRGDGS

SEQ ID NO: 1226 - protein, 41 aa, Unknown
  Description of Unknown: Linker sequence
LKARVGSADDAKKDAAKKDDAKKDDAKKDGSQTNKAKNLVQ

SEQ ID NO: 1227 - protein, 7 aa, Unknown
  Description of Unknown: Linker sequence
VAKEGET

SEQ ID NO: 1228 - protein, 14 aa, Unknown
  Description of Unknown: Linker sequence
TMKNTGRNVNDRPV

SEQ ID NO: 1229 - protein, 4 aa, Unknown
  Description of Unknown: Linker sequence
EVND

SEQ ID NO: 1230 - protein, 4 aa, Unknown
  Description of Unknown: Linker sequence
NSDG

SEQ ID NO: 1231 - protein, 4 aa, Unknown
  Description of Unknown: Linker sequence
TPYG

SEQ ID NO: 1232 - protein, 5 aa, Unknown
  Description of Unknown: Linker sequence
GRGNP

SEQ ID NO: 1233 - protein, 5 aa, Unknown
  Description of Unknown: Linker sequence
SENPV

SEQ ID NO: 1234 - protein, 6 aa, Unknown
  Description of Unknown: Linker sequence
RAQMDL

SEQ ID NO: 1235 - protein, 6 aa, Unknown
  Description of Unknown: Linker sequence
RTSRNP

SEQ ID NO: 1236 - protein, 6 aa, Unknown
  Description of Unknown: Linker sequence
YVLNDI

SEQ ID NO: 1237 - protein, 7 aa, Unknown
  Description of Unknown: Linker sequence
AKKDGTH

SEQ ID NO: 1238 - protein, 8 aa, Unknown
  Description of Unknown: Linker sequence
DATHIGKL

SEQ ID NO: 1239 - protein, 8 aa, Unknown
  Description of Unknown: Linker sequence
KQIGGDGM

SEQ ID NO: 1240 - protein, 8 aa, Unknown
  Description of Unknown: Linker sequence
VLTIPEII

SEQ ID NO: 1241 - protein, 8 aa, Unknown
  Description of Unknown: Linker sequence
YKFQEGQE

SEQ ID NO: 1242 - protein, 9 aa, Unknown
  Description of Unknown: Linker sequence
NAKDDEGVL

SEQ ID NO: 1243 - protein, 9 aa, Unknown
  Description of Unknown: Linker sequence
SYGQFEDGI

SEQ ID NO: 1244 - protein, 10 aa, Unknown
  Description of Unknown: Linker sequence
HGHVCFQFDA

SEQ ID NO: 1245 - protein, 16 aa, Unknown
  Description of Unknown: Linker sequence
LFNPWCEDDAVYLDNE

SEQ ID NO: 1246 - protein, 20 aa, Unknown
  Description of Unknown: Linker sequence
GSWDNIYAYGVPPSAWTGSV

SEQ ID NO: 1247 - protein, 20 aa, Unknown
  Description of Unknown: Linker sequence
MYGAKKPLNTEGVMKSRSNV

SEQ ID NO: 1248 - protein, 5 aa, Unknown
  Description of Unknown: Linker sequence
CPPCP

SEQ ID NO: 1249 - protein, 6 aa, Unknown
  Description of Unknown: Linker sequence
QPKAAP

SEQ ID NO: 1250 - protein, 25 aa, Unknown
  Description of Unknown: Linker sequence
PPPPPASSTTFSTTRRSSTTSSSPS

SEQ ID NO: 1251 - protein, 27 aa, Unknown
  Description of Unknown: Linker sequence
GGNPPGGNPPGTTTPRPATSTGSSPGP

SEQ ID NO: 1252 - protein, 33 aa, Unknown
  Description of Unknown: Linker sequence
GTSTGGSTTTTASGTTSTKASTTSTSSTSTGTG

SEQ ID NO: 1253 - protein, 33 aa, Unknown
  Description of Unknown: Linker sequence
TVSSSSVSSSHSSTSTSSSHSSSSTPPTQPTGV

SEQ ID NO: 1254 - protein, 34 aa, Unknown
  Description of Unknown: Linker sequence
GSSGTPPSNPSSSASPTSSTAKPSSTSTASNPSG

SEQ ID NO: 1255 - protein, 41 aa, Unknown
  Description of Unknown: Linker sequence
ASSSSSTRAASTTSRVSPTTSRSSSATPPPGSTTTRVPPVG

SEQ ID NO: 1256 - protein, 48 aa, Unknown
  Description of Unknown: Linker sequence
PSSGGTSSSSSAAPQSTSTKASTTTSAVRTTSTATTKTTSSAPAQGTN

SEQ ID NO: 1257 - protein, 6 aa, Unknown
  Description of Unknown: Linker sequence
ASTKGP

SEQ ID NO: 1258 - protein, 12 aa, Unknown
  Description of Unknown: Linker sequence
TVAAPSVFIFPP

SEQ ID NO: 1259 - protein, 13 aa, Unknown
  Description of Unknown: Linker sequence
ASTKGPSVFPLAP

SEQ ID NO: 1260 - protein, 13 aa, Unknown
  Description of Unknown: Linker sequence
QPKAAPSVTLFPP

SEQ ID NO: 1261 - protein, 5 aa, Unknown
  Description of Unknown: Linker sequence
RSANS

SEQ ID NO: 1262 - protein, 9 aa, Unknown
  Description of Unknown: Linker sequence
RPAKLALPP

SEQ ID NO: 1263 - protein, 17 aa, Unknown
  Description of Unknown: Linker sequence
SLHGFDLASEQHTVRDT

SEQ ID NO: 1264 - protein, 4 aa, Unknown
  Description of Unknown: Linker sequence
RARI

SEQ ID NO: 1265 - protein, 11 aa, Unknown
  Description of Unknown: Linker sequence
TKPQLGIREGM

SEQ ID NO: 1266 - protein, 21 aa, Unknown
  Description of Unknown: Linker sequence
HKPMAAPTTLKAGPLLSSEKL

SEQ ID NO: 1267 - protein, 12 aa, Unknown
  Description of Unknown: Linker sequence
SLPADRKPGEPV

SEQ ID NO: 1268 - protein, 6 aa, Unknown
  Description of Unknown: Linker sequence
RRHGEY

SEQ ID NO: 1269 - protein, 7 aa, Unknown
  Description of Unknown: Linker sequence
ANQNSAE

SEQ ID NO: 1270 - protein, 14 aa, Unknown
  Description of Unknown: Linker sequence
LTTNLTAFFREAHH

SEQ ID NO: 1271 - protein, 4 aa, Unknown
  Description of Unknown: Linker sequence
PNQR

SEQ ID NO: 1272 - protein, 5 aa, Unknown
  Description of Unknown: Linker sequence
ARNDP

SEQ ID NO: 1273 - protein, 5 aa, Unknown
  Description of Unknown: Linker sequence
LNWTR

SEQ ID NO: 1274 - protein, 6 aa, Unknown
  Description of Unknown: Linker sequence
DAATDR

SEQ ID NO: 1275 - protein, 6 aa, Unknown
  Description of Unknown: Linker sequence
DKASGA

SEQ ID NO: 1276 - protein, 6 aa, Unknown
  Description of Unknown: Linker sequence
GPNGNI

SEQ ID NO: 1277 - protein, 9 aa, Unknown
  Description of Unknown: Linker sequence
AWDNSDSSV

SEQ ID NO: 1278 - protein, 9 aa, Unknown
  Description of Unknown: Linker sequence
LAHVGRSLI

SEQ ID NO: 1279 - protein, 9 aa, Unknown
  Description of Unknown: Linker sequence
TKNPQRGTF

SEQ ID NO: 1280 - protein, 11 aa, Unknown
  Description of Unknown: Linker sequence
APMPAGLETWV

SEQ ID NO: 1281 - protein, 16 aa, Unknown
  Description of Unknown: Linker sequence
DTGTLPNLNSEVGAGW

SEQ ID NO: 1282 - protein, 18 aa, Unknown
  Description of Unknown: Linker sequence
ANHMWNPTGAHQSSIPAL

SEQ ID NO: 1283 - protein, 4 aa, Unknown
  Description of Unknown: Linker sequence
DATE

SEQ ID NO: 1284 - protein, 7 aa, Unknown
  Description of Unknown: Linker sequence
RNYLINS

SEQ ID NO: 1285 - protein, 14 aa, Unknown
  Description of Unknown: Linker sequence
SSPKNLDDKVKLSE

SEQ ID NO: 1286 - protein, 5 aa, Unknown
  Description of Unknown: Linker sequence
QYQIV

SEQ ID NO: 1287 - protein, 8 aa, Unknown
  Description of Unknown: Linker sequence
RWLKNASP

SEQ ID NO: 1288 - protein, 4 aa, Unknown
  Description of Unknown: Linker sequence
GFLG

SEQ ID NO: 1289 - protein, 6 aa, Unknown
  Description of Unknown: Linker sequence
PLGLWA

SEQ ID NO: 1290 - protein, 6 aa, Unknown
  Description of Unknown: Linker sequence
RVLAEA

SEQ ID NO: 1291 - protein, 8 aa, Unknown
  Description of Unknown: Linker sequence
GGIEGRGS

SEQ ID NO: 1292 - protein, 9 aa, Unknown
  Description of Unknown: Linker sequence
RRRRRRRRR

SEQ ID NO: 1293 - protein, 10 aa, Unknown
  Description of Unknown: Linker sequence
EDVVCCSMSY

SEQ ID NO: 1294 - protein, 10 aa, Unknown
  Description of Unknown: Linker sequence
TRHRQPRGWE

SEQ ID NO: 1295 - protein, 10 aa, Unknown
  Description of Unknown: Linker sequence
AGNRVRRSVG

SEQ ID NO: 1296 - protein, 12 aa, Unknown
  Description of Unknown: Linker sequence
CRRRRRREAEAC

SEQ ID NO: 1297 - protein, 17 aa, Unknown
  Description of Unknown: Linker sequence
VSQTSKLTRAETVFPDV

SEQ ID NO: 1298 - protein, 20 aa, Unknown
  Description of Unknown: Linker sequence
LEAGCKNFFPRSFTSCGSLE

SEQ ID NO: 1299 - protein, 14 aa, Unknown
  Description of Unknown: Linker sequence
NILNDRNPVVTEDV

SEQ ID NO: 1300 - protein, 5 aa, Unknown
  Description of Unknown: Linker sequence
YTPGE

SEQ ID NO: 1301 - protein, 4 aa, Unknown
  Description of Unknown: Linker sequence
FGTQ

SEQ ID NO: 1302 - protein, 6 aa, Unknown
  Description of Unknown: Linker sequence
SLQSGY

SEQ ID NO: 1303 - protein, 6 aa, Unknown
  Description of Unknown: Linker sequence
TIPANR

SEQ ID NO: 1304 - protein, 9 aa, Unknown
  Description of Unknown: Linker sequence
KSEKGRNKF

SEQ ID NO: 1305 - protein, 7 aa, Unknown
  Description of Unknown: Linker sequence
YFNKYSS

SEQ ID NO: 1306 - protein, 8 aa, Unknown
  Description of Unknown: Linker sequence
YRNPSRNI

SEQ ID NO: 1307 - protein, 4 aa, Unknown
  Description of Unknown: Linker sequence
YGLN

SEQ ID NO: 1308 - protein, 5 aa, Unknown
  Description of Unknown: Linker sequence
IMGSV

SEQ ID NO: 1309 - protein, 5 aa, Unknown
  Description of Unknown: Linker sequence
SGRDA

SEQ ID NO: 1310 - protein, 6 aa, Unknown
  Description of Unknown: Linker sequence
LIEKGG

SEQ ID NO: 1311 - protein, 7 aa, Unknown
  Description of Unknown: Linker sequence
DINNISP

SEQ ID NO: 1312 - protein, 7 aa, Unknown
  Description of Unknown: Linker sequence
GRHVRGI

SEQ ID NO: 1313 - protein, 8 aa, Unknown
  Description of Unknown: Linker sequence
VRGREPGD

SEQ ID NO: 1314 - protein, 6 aa, Unknown
  Description of Unknown: Linker sequence
EMEIPE

SEQ ID NO: 1315 - protein, 6 aa, Unknown
  Description of Unknown: Linker sequence
RMIKSA

SEQ ID NO: 1316 - protein, 4 aa, Unknown
  Description of Unknown: Linker sequence
GFTP

SEQ ID NO: 1317 - protein, 5 aa, Unknown
  Description of Unknown: Linker sequence
FKIDV

SEQ ID NO: 1318 - protein, 5 aa, Unknown
  Description of Unknown: Linker sequence
NLDDP

SEQ ID NO: 1319 - protein, 11 aa, Unknown
  Description of Unknown: Linker sequence
LQNQQDNRGNI

SEQ ID NO: 1320 - protein, 19 aa, Unknown
  Description of Unknown: Linker sequence
NPQGQVWIEGREQQPQKNI

SEQ ID NO: 1321 - protein, 35 aa, Unknown
  Description of Unknown: Linker sequence
RVQGPFSVIRPPLRSQRPQEEVNGLEETICSARCT

SEQ ID NO: 1322 - protein, 53 aa, Unknown
  Description of Unknown: Linker sequence
DSSVFQPGGGSPFGEGQGQGQQGQGQGHQGQGQGQQGQQGQQGQQSQGQGFRD

SEQ ID NO: 1323 - protein, 5 aa, Unknown
  Description of Unknown: Linker sequence
CEGSD

SEQ ID NO: 1324 - protein, 7 aa, Unknown
  Description of Unknown: Linker sequence
VQQQETI

SEQ ID NO: 1325 - protein, 8 aa, Unknown
  Description of Unknown: Linker sequence
KGINSKKT

SEQ ID NO: 1326 - protein, 12 aa, Unknown
  Description of Unknown: Linker sequence
RLKLEDRQVDLT

SEQ ID NO: 1327 - protein, 8 aa, Unknown
  Description of Unknown: Linker sequence
TDSTQIKM

SEQ ID NO: 1328 - protein, 11 aa, Unknown
  Description of Unknown: Linker sequence
ILLQYNTEDAY

SEQ ID NO: 1329 - protein, 14 aa, Unknown
  Description of Unknown: Linker sequence
ELVTNCFKNRYTLQ

SEQ ID NO: 1330 - protein, 23 aa, Unknown
  Description of Unknown: Linker sequence
IKLYLGYKNKKLRVNINVPMKTE

SEQ ID NO: 1331 - protein, 24 aa, Unknown
  Description of Unknown: Linker sequence
KSKLLVLEDENANVDEVELKPDTL

SEQ ID NO: 1332 - protein, 11 aa, Unknown
  Description of Unknown: Linker sequence
VLTFDLAAPTV

SEQ ID NO: 1333 - protein, 27 aa, Unknown
  Description of Unknown: Linker sequence
CPAGNFIGKTATPYTSGTPCGDCPSDC

SEQ ID NO: 1334 - protein, 8 aa, Unknown
  Description of Unknown: Linker sequence
HLPGREAH

SEQ ID NO: 1335 - protein, 8 aa, Unknown
  Description of Unknown: Linker sequence
YLPDAFGP

SEQ ID NO: 1336 - protein, 21 aa, Unknown
  Description of Unknown: Linker sequence
LEIKTLLMDEQDHGYALTGDA

SEQ ID NO: 1337 - protein, 7 aa, Unknown
  Description of Unknown: Linker sequence
VLAMAKV

SEQ ID NO: 1338 - protein, 4 aa, Unknown
  Description of Unknown: Linker sequence
FAFG

SEQ ID NO: 1339 - protein, 4 aa, Unknown
  Description of Unknown: Linker sequence
GPNQ

SEQ ID NO: 1340 - protein, 8 aa, Unknown
  Description of Unknown: Linker sequence
DEINNPSL

SEQ ID NO: 1341 - protein, 24 aa, Unknown
  Description of Unknown: Linker sequence
VIPAGKLERVDPTTVRQEGPWADP

SEQ ID NO: 1342 - protein, 15 aa, Unknown
  Description of Unknown: Linker sequence
LGVSSSEVSRVEADS

SEQ ID NO: 1343 - protein, 6 aa, Unknown
  Description of Unknown: Linker sequence
AIPDFG

SEQ ID NO: 1344 - protein, 6 aa, Unknown
  Description of Unknown: Linker sequence
VDPAYR

SEQ ID NO: 1345 - protein, 6 aa, Unknown
  Description of Unknown: Linker sequence
YAPSSP

SEQ ID NO: 1346 - protein, 23 aa, Unknown
  Description of Unknown: Linker sequence
ATPQMEEDKGPINHPQYPGDVGL

SEQ ID NO: 1347 - protein, 4 aa, Unknown
  Description of Unknown: Linker sequence
IWEP

SEQ ID NO: 1348 - protein, 6 aa, Unknown
  Description of Unknown: Linker sequence
RTDIQT

SEQ ID NO: 1349 - protein, 13 aa, Unknown
  Description of Unknown: Linker sequence
KIPFTANKFEKNY

SEQ ID NO: 1350 - protein, 10 aa, Unknown
  Description of Unknown: Linker sequence
LEGDKNALNQ

SEQ ID NO: 1351 - protein, 4 aa, Unknown
  Description of Unknown: Linker sequence
AGGD

SEQ ID NO: 1352 - protein, 4 aa, Unknown
  Description of Unknown: Linker sequence
KADV

SEQ ID NO: 1353 - protein, 4 aa, Unknown
  Description of Unknown: Linker sequence
KGGR

SEQ ID NO: 1354 - protein, 4 aa, Unknown
  Description of Unknown: Linker sequence
LGTF

SEQ ID NO: 1355 - protein, 4 aa, Unknown
  Description of Unknown: Linker sequence
LPFL

SEQ ID NO: 1356 - protein, 4 aa, Unknown
  Description of Unknown: Linker sequence
QKGK

SEQ ID NO: 1357 - protein, 5 aa, Unknown
  Description of Unknown: Linker sequence
EEKCE

SEQ ID NO: 1358 - protein, 5 aa, Unknown
  Description of Unknown: Linker sequence
LGAGD

SEQ ID NO: 1359 - protein, 5 aa, Unknown
  Description of Unknown: Linker sequence
LKSIE

SEQ ID NO: 1360 - protein, 5 aa, Unknown
  Description of Unknown: Linker sequence
PKTDD

SEQ ID NO: 1361 - protein, 5 aa, Unknown
  Description of Unknown: Linker sequence
SAFGS

SEQ ID NO: 1362 - protein, 5 aa, Unknown
  Description of Unknown: Linker sequence
VLRDP

SEQ ID NO: 1363 - protein, 6 aa, Unknown
  Description of Unknown: Linker sequence
EEGYKA

SEQ ID NO: 1364 - protein, 6 aa, Unknown
  Description of Unknown: Linker sequence
KDLGVK

SEQ ID NO: 1365 - protein, 6 aa, Unknown
  Description of Unknown: Linker sequence
LVDISV

SEQ ID NO: 1366 - protein, 6 aa, Unknown
  Description of Unknown: Linker sequence
NIRAVP

SEQ ID NO: 1367 - protein, 6 aa, Unknown
  Description of Unknown: Linker sequence
RCGARR

SEQ ID NO: 1368 - protein, 6 aa, Unknown
  Description of Unknown: Linker sequence
VFRKGF

SEQ ID NO: 1369 - protein, 6 aa, Unknown
  Description of Unknown: Linker sequence
VIGKAL

SEQ ID NO: 1370 - protein, 7 aa, Unknown
  Description of Unknown: Linker sequence
IGIGLPE

SEQ ID NO: 1371 - protein, 7 aa, Unknown
  Description of Unknown: Linker sequence
QDETGKW

SEQ ID NO: 1372 - protein, 7 aa, Unknown
  Description of Unknown: Linker sequence
VGMANTT

SEQ ID NO: 1373 - protein, 8 aa, Unknown
  Description of Unknown: Linker sequence
ELSNIEQV

SEQ ID NO: 1374 - protein, 10 aa, Unknown
  Description of Unknown: Linker sequence
FQGLTQDQGF

SEQ ID NO: 1375 - protein, 12 aa, Unknown
  Description of Unknown: Linker sequence
CGKSLSENEITL

SEQ ID NO: 1376 - protein, 14 aa, Unknown
  Description of Unknown: Linker sequence
LQGWDGQSPGTESH

SEQ ID NO: 1377 - protein, 17 aa, Unknown
  Description of Unknown: Linker sequence
PVPRIAELMGKKLPNFG

SEQ ID NO: 1378 - protein, 18 aa, Unknown
  Description of Unknown: Linker sequence
QYGASVSAKPELPLFYTP

SEQ ID NO: 1379 - protein, 18 aa, Unknown
  Description of Unknown: Linker sequence
SKAGMCACHSPLPSIRGA

SEQ ID NO: 1380 - protein, 23 aa, Unknown
  Description of Unknown: Linker sequence
EQNAAFPPLERKPFIPKKPIPAI

SEQ ID NO: 1381 - protein, 28 aa, Unknown
  Description of Unknown: Linker sequence
EALSPIKFNRWDLPEVDPETMQTSEPWV

SEQ ID NO: 1382 - protein, 7 aa, Unknown
  Description of Unknown: Linker sequence
NTGSGKR

SEQ ID NO: 1383 - protein, 7 aa, Unknown
  Description of Unknown: Linker sequence
TQPVQSS

SEQ ID NO: 1384 - protein, 7 aa, Unknown
  Description of Unknown: Linker sequence
YTGDNCA

SEQ ID NO: 1385 - protein, 18 aa, Unknown
  Description of Unknown: Linker sequence
LPRDGLKDPQGKPLHYDR

SEQ ID NO: 1386 - protein, 7 aa, Unknown
  Description of Unknown: Linker sequence
DDDRIKD

SEQ ID NO: 1387 - protein, 7 aa, Unknown
  Description of Unknown: Linker sequence
EAEKNQQ

SEQ ID NO: 1388 - protein, 11 aa, Unknown
  Description of Unknown: Linker sequence
NHLGIDLGETP

SEQ ID NO: 1389 - protein, 13 aa, Unknown
  Description of Unknown: Linker sequence
RLFESSGCAGKLA

SEQ ID NO: 1390 - protein, 13 aa, Unknown
  Description of Unknown: Linker sequence
VRHDGRHAHDYDY

SEQ ID NO: 1391 - protein, 15 aa, Unknown
  Description of Unknown: Linker sequence
RDIEADTPARYNADP

SEQ ID NO: 1392 - protein, 4 aa, Unknown
  Description of Unknown: Linker sequence
LSSR

SEQ ID NO: 1393 - protein, 4 aa, Unknown
  Description of Unknown: Linker sequence
SILM

SEQ ID NO: 1394 - protein, 5 aa, Unknown
  Description of Unknown: Linker sequence
DTSGG

SEQ ID NO: 1395 - protein, 5 aa, Unknown
  Description of Unknown: Linker sequence
LGDGA

SEQ ID NO: 1396 - protein, 6 aa, Unknown
  Description of Unknown: Linker sequence
ANNSTL

SEQ ID NO: 1397 - protein, 6 aa, Unknown
  Description of Unknown: Linker sequence
IDEIQK

SEQ ID NO: 1398 - protein, 6 aa, Unknown
  Description of Unknown: Linker sequence
KLPSFE

SEQ ID NO: 1399 - protein, 6 aa, Unknown
  Description of Unknown: Linker sequence
QEVSQC

SEQ ID NO: 1400 - protein, 6 aa, Unknown
  Description of Unknown: Linker sequence
RSLSTT

SEQ ID NO: 1401 - protein, 6 aa, Unknown
  Description of Unknown: Linker sequence
SSNHKL

SEQ ID NO: 1402 - protein, 6 aa, Unknown
  Description of Unknown: Linker sequence
TFESSH

SEQ ID NO: 1403 - protein, 7 aa, Unknown
  Description of Unknown: Linker sequence
TALRPSA

SEQ ID NO: 1404 - protein, 8 aa, Unknown
  Description of Unknown: Linker sequence
PLYESPRK

SEQ ID NO: 1405 - protein, 9 aa, Unknown
  Description of Unknown: Linker sequence
LNSDGYPDS

SEQ ID NO: 1406 - protein, 9 aa, Unknown
  Description of Unknown: Linker sequence
LWTDISARI

SEQ ID NO: 1407 - protein, 11 aa, Unknown
  Description of Unknown: Linker sequence
HKEMLGGEIIP

SEQ ID NO: 1408 - protein, 12 aa, Unknown
  Description of Unknown: Linker sequence
TLGTQPTVLRTF

SEQ ID NO: 1409 - protein, 12 aa, Unknown
  Description of Unknown: Linker sequence
VFSNVNLKEVNY

SEQ ID NO: 1410 - protein, 13 aa, Unknown
  Description of Unknown: Linker sequence
NVFACSDRPTVIY

SEQ ID NO: 1411 - protein, 14 aa, Unknown
  Description of Unknown: Linker sequence
DITPLGDSNGLSPL

SEQ ID NO: 1412 - protein, 14 aa, Unknown
  Description of Unknown: Linker sequence
FGLNIETGLLSDRK

SEQ ID NO: 1413 - protein, 29 aa, Unknown
  Description of Unknown: Linker sequence
TQALSSSVSSSKLFSSSTAPHETSFGEEV

SEQ ID NO: 1414 - protein, 4 aa, Unknown
  Description of Unknown: Linker sequence
EHGV

SEQ ID NO: 1415 - protein, 4 aa, Unknown
  Description of Unknown: Linker sequence
REGK

SEQ ID NO: 1416 - protein, 5 aa, Unknown
  Description of Unknown: Linker sequence
TVLHA

SEQ ID NO: 1417 - protein, 6 aa, Unknown
  Description of Unknown: Linker sequence
ETEKTG

SEQ ID NO: 1418 - protein, 6 aa, Unknown
  Description of Unknown: Linker sequence
FHYEGG

SEQ ID NO: 1419 - protein, 6 aa, Unknown
  Description of Unknown: Linker sequence
LDSGVS

SEQ ID NO: 1420 - protein, 6 aa, Unknown
  Description of Unknown: Linker sequence
PQAPLA

SEQ ID NO: 1421 - protein, 7 aa, Unknown
  Description of Unknown: Linker sequence
DKRDGKE

SEQ ID NO: 1422 - protein, 8 aa, Unknown
  Description of Unknown: Linker sequence
IHPEEGVS

SEQ ID NO: 1423 - protein, 14 aa, Unknown
  Description of Unknown: Linker sequence
PSLETFTNVTEFEY

SEQ ID NO: 1424 - protein, 19 aa, Unknown
  Description of Unknown: Linker sequence
GGKFDDNSYKVSGGLHGVG

SEQ ID NO: 1425 - protein, 5 aa, Unknown
  Description of Unknown: Linker sequence
MKPEN

SEQ ID NO: 1426 - protein, 6 aa, Unknown
  Description of Unknown: Linker sequence
TNISRA

SEQ ID NO: 1427 - protein, 7 aa, Unknown
  Description of Unknown: Linker sequence
LLESGRL

SEQ ID NO: 1428 - protein, 15 aa, Unknown
  Description of Unknown: Linker sequence
VWGTKGLANEGKVIG

SEQ ID NO: 1429 - protein, 28 aa, Unknown
  Description of Unknown: Linker sequence
TLSQWGFFSPYGIGDNDACTINPYDGWA

SEQ ID NO: 1430 - protein, 4 aa, Unknown
  Description of Unknown: Linker sequence
MERE

SEQ ID NO: 1431 - protein, 7 aa, Unknown
  Description of Unknown: Linker sequence
FIDKPGI

SEQ ID NO: 1432 - protein, 8 aa, Unknown
  Description of Unknown: Linker sequence
TLNYTCPT

SEQ ID NO: 1433 - protein, 10 aa, Unknown
  Description of Unknown: Linker sequence
LLQERQDNLL

SEQ ID NO: 1434 - protein, 12 aa, Unknown
  Description of Unknown: Linker sequence
QRTTLPHIRSIT

SEQ ID NO: 1435 - protein, 4 aa, Unknown
  Description of Unknown: Linker sequence
VGGF

SEQ ID NO: 1436 - protein, 5 aa, Unknown
  Description of Unknown: Linker sequence
AKIQI

SEQ ID NO: 1437 - protein, 5 aa, Unknown
  Description of Unknown: Linker sequence
KEQNK

SEQ ID NO: 1438 - protein, 7 aa, Unknown
  Description of Unknown: Linker sequence
PGPKCPF

SEQ ID NO: 1439 - protein, 9 aa, Unknown
  Description of Unknown: Linker sequence
QLNYISIAS

SEQ ID NO: 1440 - protein, 9 aa, Unknown
  Description of Unknown: Linker sequence
SANNIAKYD

SEQ ID NO: 1441 - protein, 16 aa, Unknown
  Description of Unknown: Linker sequence
AIKGNIDAPQVVEGEK

SEQ ID NO: 1442 - protein, 18 aa, Unknown
  Description of Unknown: Linker sequence
VIPQGRSHPVQPYPGAFV

SEQ ID NO: 1443 - protein, 4 aa, Unknown
  Description of Unknown: Linker sequence
ETSR

SEQ ID NO: 1444 - protein, 5 aa, Unknown
  Description of Unknown: Linker sequence
GVGRR

SEQ ID NO: 1445 - protein, 6 aa, Unknown
  Description of Unknown: Linker sequence
FFLGQI

SEQ ID NO: 1446 - protein, 6 aa, Unknown
  Description of Unknown: Linker sequence
LEGSSL

SEQ ID NO: 1447 - protein, 8 aa, Unknown
  Description of Unknown: Linker sequence
DLSQVNEL

SEQ ID NO: 1448 - protein, 8 aa, Unknown
  Description of Unknown: Linker sequence
KNANGDYF

SEQ ID NO: 1449 - protein, 11 aa, Unknown
  Description of Unknown: Linker sequence
ILPLPYPNSPV

SEQ ID NO: 1450 - protein, 12 aa, Unknown
  Description of Unknown: Linker sequence
FADPTIQSQSEI

SEQ ID NO: 1451 - protein, 13 aa, Unknown
  Description of Unknown: Linker sequence
CGPYFANDNFSLE

SEQ ID NO: 1452 - protein, 15 aa, Unknown
  Description of Unknown: Linker sequence
PDSPTYDKFLNPESL

SEQ ID NO: 1453 - protein, 4 aa, Unknown
  Description of Unknown: Linker sequence
TGDL

SEQ ID NO: 1454 - protein, 6 aa, Unknown
  Description of Unknown: Linker sequence
FDNEYE

SEQ ID NO: 1455 - protein, 7 aa, Unknown
  Description of Unknown: Linker sequence
SLKFEGD

SEQ ID NO: 1456 - protein, 13 aa, Unknown
  Description of Unknown: Linker sequence
VFNPEGRDLITDW

SEQ ID NO: 1457 - protein, 15 aa, Unknown
  Description of Unknown: Linker sequence
GGNYDINSHLPLIPE

SEQ ID NO: 1458 - protein, 5 aa, Unknown
  Description of Unknown: Linker sequence
RNEQD

SEQ ID NO: 1459 - protein, 4 aa, Unknown
  Description of Unknown: Linker sequence
KEGK

SEQ ID NO: 1460 - protein, 5 aa, Unknown
  Description of Unknown: Linker sequence
MEQAM

SEQ ID NO: 1461 - protein, 6 aa, Unknown
  Description of Unknown: Linker sequence
ILRVNV

SEQ ID NO: 1462 - protein, 7 aa, Unknown
  Description of Unknown: Linker sequence
LPDGEDP

SEQ ID NO: 1463 - protein, 7 aa, Unknown
  Description of Unknown: Linker sequence
LSIGIRR

SEQ ID NO: 1464 - protein, 8 aa, Unknown
  Description of Unknown: Linker sequence
DNAEPNRL

SEQ ID NO: 1465 - protein, 17 aa, Unknown
  Description of Unknown: Linker sequence
GFVRKAILASFPEGVGI

SEQ ID NO: 1466 - protein, 4 aa, Unknown
  Description of Unknown: Linker sequence
VDGV

SEQ ID NO: 1467 - protein, 5 aa, Unknown
  Description of Unknown: Linker sequence
LWNGG

SEQ ID NO: 1468 - protein, 5 aa, Unknown
  Description of Unknown: Linker sequence
RGISK

SEQ ID NO: 1469 - protein, 7 aa, Unknown
  Description of Unknown: Linker sequence
CYVCEKW

SEQ ID NO: 1470 - protein, 7 aa, Unknown
  Description of Unknown: Linker sequence
RDQNGNI

SEQ ID NO: 1471 - protein, 8 aa, Unknown
  Description of Unknown: Linker sequence
RDKDKNFK

SEQ ID NO: 1472 - protein, 8 aa, Unknown
  Description of Unknown: Linker sequence
TAGNEDTK

SEQ ID NO: 1473 - protein, 9 aa, Unknown
  Description of Unknown: Linker sequence
ESNGRYSAL

SEQ ID NO: 1474 - protein, 11 aa, Unknown
  Description of Unknown: Linker sequence
GSHKSDALFGK

SEQ ID NO: 1475 - protein, 18 aa, Unknown
  Description of Unknown: Linker sequence
SKRKPSGGKPGTYNVWNF

SEQ ID NO: 1476 - protein, 4 aa, Unknown
  Description of Unknown: Linker sequence
FYNM

SEQ ID NO: 1477 - protein, 4 aa, Unknown
  Description of Unknown: Linker sequence
KFTW

SEQ ID NO: 1478 - protein, 6 aa, Unknown
  Description of Unknown: Linker sequence
FITPII

SEQ ID NO: 1479 - protein, 6 aa, Unknown
  Description of Unknown: Linker sequence
FSKKKA

SEQ ID NO: 1480 - protein, 7 aa, Unknown
  Description of Unknown: Linker sequence
SNLDRHL

SEQ ID NO: 1481 - protein, 8 aa, Unknown
  Description of Unknown: Linker sequence
FHSLQGND

SEQ ID NO: 1482 - protein, 8 aa, Unknown
  Description of Unknown: Linker sequence
ITKPTKNT

SEQ ID NO: 1483 - protein, 10 aa, Unknown
  Description of Unknown: Linker sequence
YYKGLGTSLA

SEQ ID NO: 1484 - protein, 14 aa, Unknown
  Description of Unknown: Linker sequence
QYEPGTVLDPTLKE

SEQ ID NO: 1485 - protein, 6 aa, Unknown
  Description of Unknown: Linker sequence
LNPSSR

SEQ ID NO: 1486 - protein, 8 aa, Unknown
  Description of Unknown: Linker sequence
QRAPPKTF

SEQ ID NO: 1487 - protein, 12 aa, Unknown
  Description of Unknown: Linker sequence
ADAKVMKDAKTK

SEQ ID NO: 1488 - protein, 4 aa, Unknown
  Description of Unknown: Linker sequence
LNGN

SEQ ID NO: 1489 - protein, 5 aa, Unknown
  Description of Unknown: Linker sequence
AGEME

SEQ ID NO: 1490 - protein, 6 aa, Unknown
  Description of Unknown: Linker sequence
MDNMGR

SEQ ID NO: 1491 - protein, 6 aa, Unknown
  Description of Unknown: Linker sequence
SREYKK

SEQ ID NO: 1492 - protein, 6 aa, Unknown
  Description of Unknown: Linker sequence
STKDVK

SEQ ID NO: 1493 - protein, 7 aa, Unknown
  Description of Unknown: Linker sequence
KLPVKGF

SEQ ID NO: 1494 - protein, 7 aa, Unknown
  Description of Unknown: Linker sequence
PFNGEDY

SEQ ID NO: 1495 - protein, 8 aa, Unknown
  Description of Unknown: Linker sequence
FKMQSLDK

SEQ ID NO: 1496 - protein, 4 aa, Unknown
  Description of Unknown: Linker sequence
TPEG

SEQ ID NO: 1497 - protein, 5 aa, Unknown
  Description of Unknown: Linker sequence
VGPLK

SEQ ID NO: 1498 - protein, 6 aa, Unknown
  Description of Unknown: Linker sequence
ETDADF

SEQ ID NO: 1499 - protein, 8 aa, Unknown
  Description of Unknown: Linker sequence
IPEEDGSS

SEQ ID NO: 1500 - protein, 9 aa, Unknown
  Description of Unknown: Linker sequence
DCTKLGTGA

SEQ ID NO: 1501 - protein, 10 aa, Unknown
  Description of Unknown: Linker sequence
NIPNDVTKLN

SEQ ID NO: 1502 - protein, 15 aa, Unknown
  Description of Unknown: Linker sequence
GAARPGLRLPGCVDA

SEQ ID NO: 1503 - protein, 12 aa, Unknown
  Description of Unknown: Linker sequence
RLRRNDDEPAEM

SEQ ID NO: 1504 - protein, 4 aa, Unknown
  Description of Unknown: Linker sequence
LDQR

SEQ ID NO: 1505 - protein, 5 aa, Unknown
  Description of Unknown: Linker sequence
VDGNR

SEQ ID NO: 1506 - protein, 6 aa, Unknown
  Description of Unknown: Linker sequence
PLRRFY

SEQ ID NO: 1507 - protein, 6 aa, Unknown
  Description of Unknown: Linker sequence
YAEEDG

SEQ ID NO: 1508 - protein, 6 aa, Unknown
  Description of Unknown: Linker sequence
YEDGRL

SEQ ID NO: 1509 - protein, 7 aa, Unknown
  Description of Unknown: Linker sequence
RSNQGTA

SEQ ID NO: 1510 - protein, 10 aa, Unknown
  Description of Unknown: Linker sequence
DGPASENGFL

SEQ ID NO: 1511 - protein, 14 aa, Unknown
  Description of Unknown: Linker sequence
PRVVVGQRVRKGDL

SEQ ID NO: 1512 - protein, 16 aa, Unknown
  Description of Unknown: Linker sequence
ELITNIGETAGVVQDI

SEQ ID NO: 1513 - protein, 20 aa, Unknown
  Description of Unknown: Linker sequence
SDPTLPRSDRECPKCHSREN

SEQ ID NO: 1514 - protein, 5 aa, Unknown
  Description of Unknown: Linker sequence
VEGEV

SEQ ID NO: 1515 - protein, 8 aa, Unknown
  Description of Unknown: Linker sequence
YVPVVQEV

SEQ ID NO: 1516 - protein, 4 aa, Unknown
  Description of Unknown: Linker sequence
YQNN

SEQ ID NO: 1517 - protein, 5 aa, Unknown
  Description of Unknown: Linker sequence
LVVNI

SEQ ID NO: 1518 - protein, 6 aa, Unknown
  Description of Unknown: Linker sequence
EKNFQT

SEQ ID NO: 1519 - protein, 11 aa, Unknown
  Description of Unknown: Linker sequence
MKLVPSIPPAT

SEQ ID NO: 1520 - protein, 14 aa, Unknown
  Description of Unknown: Linker sequence
TQPDVPFKNPDNVV

SEQ ID NO: 1521 - protein, 32 aa, Unknown
  Description of Unknown: Linker sequence
YPEDHNEPQSVRAASSDPGEVVPSACAADEPV

SEQ ID NO: 1522 - protein, 4 aa, Unknown
  Description of Unknown: Linker sequence
ALCL

SEQ ID NO: 1523 - protein, 4 aa, Unknown
  Description of Unknown: Linker sequence
LLSL

SEQ ID NO: 1524 - protein, 7 aa, Unknown
  Description of Unknown: Linker sequence
LNNVRFS

SEQ ID NO: 1525 - protein, 7 aa, Unknown
  Description of Unknown: Linker sequence
SLCKAHL

SEQ ID NO: 1526 - protein, 8 aa, Unknown
  Description of Unknown: Linker sequence
EHNNLVNV

SEQ ID NO: 1527 - protein, 8 aa, Unknown
  Description of Unknown: Linker sequence
YDTGRTGR

SEQ ID NO: 1528 - protein, 11 aa, Unknown
  Description of Unknown: Linker sequence
QHNLKQNDQPQ

SEQ ID NO: 1529 - protein, 11 aa, Unknown
  Description of Unknown: Linker sequence
LYPNAQTGHGH

SEQ ID NO: 1530 - protein, 13 aa, Unknown
  Description of Unknown: Linker sequence
AEVTYKHHEPTGC

SEQ ID NO: 1531 - protein, 4 aa, Unknown
  Description of Unknown: Linker sequence
MITP

SEQ ID NO: 1532 - protein, 8 aa, Unknown
  Description of Unknown: Linker sequence
LQHPKIIK

SEQ ID NO: 1533 - protein, 12 aa, Unknown
  Description of Unknown: Linker sequence
REDEEMGLTTTS

SEQ ID NO: 1534 - protein, 5 aa, Unknown
  Description of Unknown: Linker sequence
GSREE

SEQ ID NO: 1535 - protein, 4 aa, Unknown
  Description of Unknown: Linker sequence
ENTC

SEQ ID NO: 1536 - protein, 11 aa, Unknown
  Description of Unknown: Linker sequence
PVSGAKTFKNE

SEQ ID NO: 1537 - protein, 5 aa, Unknown
  Description of Unknown: Linker sequence
LSQDD

SEQ ID NO: 1538 - protein, 8 aa, Unknown
  Description of Unknown: Linker sequence
LLGADDDL

SEQ ID NO: 1539 - protein, 4 aa, Unknown
  Description of Unknown: Linker sequence
GHGE

SEQ ID NO: 1540 - protein, 4 aa, Unknown
  Description of Unknown: Linker sequence
PKGR

SEQ ID NO: 1541 - protein, 5 aa, Unknown
  Description of Unknown: Linker sequence
ALPSP

SEQ ID NO: 1542 - protein, 6 aa, Unknown
  Description of Unknown: Linker sequence
DYGVEV

SEQ ID NO: 1543 - protein, 6 aa, Unknown
  Description of Unknown: Linker sequence
EDPSLK

SEQ ID NO: 1544 - protein, 7 aa, Unknown
  Description of Unknown: Linker sequence
FGDGPPL

SEQ ID NO: 1545 - protein, 8 aa, Unknown
  Description of Unknown: Linker sequence
RQEETGEL

SEQ ID NO: 1546 - protein, 8 aa, Unknown
  Description of Unknown: Linker sequence
SVPKVPYR

SEQ ID NO: 1547 - protein, 8 aa, Unknown
  Description of Unknown: Linker sequence
WQGEKPES

SEQ ID NO: 1548 - protein, 12 aa, Unknown
  Description of Unknown: Linker sequence
EVPFARLPDPNV

SEQ ID NO: 1549 - protein, 4 aa, Unknown
  Description of Unknown: Linker sequence
DIYV

SEQ ID NO: 1550 - protein, 6 aa, Unknown
  Description of Unknown: Linker sequence
IGENIN

SEQ ID NO: 1551 - protein, 7 aa, Unknown
  Description of Unknown: Linker sequence
AGKITDV

SEQ ID NO: 1552 - protein, 8 aa, Unknown
  Description of Unknown: Linker sequence
KAGNVAAD

SEQ ID NO: 1553 - protein, 14 aa, Unknown
  Description of Unknown: Linker sequence
YIPVPTRDLEKPFL

SEQ ID NO: 1554 - protein, 4 aa, Unknown
  Description of Unknown: Linker sequence
GEHI

SEQ ID NO: 1555 - protein, 4 aa, Unknown
  Description of Unknown: Linker sequence
EGPE

SEQ ID NO: 1556 - protein, 4 aa, Unknown
  Description of Unknown: Linker sequence
FEWT

SEQ ID NO: 1557 - protein, 4 aa, Unknown
  Description of Unknown: Linker sequence
KATY

SEQ ID NO: 1558 - protein, 4 aa, Unknown
  Description of Unknown: Linker sequence
KDGV

SEQ ID NO: 1559 - protein, 4 aa, Unknown
  Description of Unknown: Linker sequence
LLGS

SEQ ID NO: 1560 - protein, 4 aa, Unknown
  Description of Unknown: Linker sequence
VSKS

SEQ ID NO: 1561 - protein, 7 aa, Unknown
  Description of Unknown: Linker sequence
KAPDGRI

SEQ ID NO: 1562 - protein, 8 aa, Unknown
  Description of Unknown: Linker sequence
RKASNKAY

SEQ ID NO: 1563 - protein, 10 aa, Unknown
  Description of Unknown: Linker sequence
YAPILYENDH

SEQ ID NO: 1564 - protein, 4 aa, Unknown
  Description of Unknown: Linker sequence
YSLG

SEQ ID NO: 1565 - protein, 6 aa, Unknown
  Description of Unknown: Linker sequence
LDPQWS

SEQ ID NO: 1566 - protein, 7 aa, Unknown
  Description of Unknown: Linker sequence
REGNGPT

SEQ ID NO: 1567 - protein, 7 aa, Unknown
  Description of Unknown: Linker sequence
RGEQVAF

SEQ ID NO: 1568 - protein, 8 aa, Unknown
  Description of Unknown: Linker sequence
QQPHGPYY

SEQ ID NO: 1569 - protein, 11 aa, Unknown
  Description of Unknown: Linker sequence
LDTWPPETQNW

SEQ ID NO: 1570 - protein, 13 aa, Unknown
  Description of Unknown: Linker sequence
CFHPASGFAWQFS

SEQ ID NO: 1571 - protein, 16 aa, Unknown
  Description of Unknown: Linker sequence
GIQSPRPNGPMQTAAN

SEQ ID NO: 1572 - protein, 17 aa, Unknown
  Description of Unknown: Linker sequence
IDAEEDSTRRMGFETIL

SEQ ID NO: 1573 - protein, 22 aa, Unknown
  Description of Unknown: Linker sequence
EMPDAPLQPGWDRPETPYSPPL

SEQ ID NO: 1574 - protein, 6 aa, Unknown
  Description of Unknown: Linker sequence
LLDAPV

SEQ ID NO: 1575 - protein, 5 aa, Unknown
  Description of Unknown: Linker sequence
EHIDL

SEQ ID NO: 1576 - protein, 5 aa, Unknown
  Description of Unknown: Linker sequence
FGCDK

SEQ ID NO: 1577 - protein, 7 aa, Unknown
  Description of Unknown: Linker sequence
CDCKHTT

SEQ ID NO: 1578 - protein, 9 aa, Unknown
  Description of Unknown: Linker sequence
LNGNDNTIK

SEQ ID NO: 1579 - protein, 10 aa, Unknown
  Description of Unknown: Linker sequence
ISENKNDAKV

SEQ ID NO: 1580 - protein, 8 aa, Unknown
  Description of Unknown: Linker sequence
TAACTNTS

SEQ ID NO: 1581 - protein, 4 aa, Unknown
  Description of Unknown: Linker sequence
LTLL

SEQ ID NO: 1582 - protein, 12 aa, Unknown
  Description of Unknown: Linker sequence
DWENWQNVGQWR

SEQ ID NO: 1583 - protein, 8 aa, Unknown
  Description of Unknown: Linker sequence
STKNPVHA

SEQ ID NO: 1584 - protein, 5 aa, Unknown
  Description of Unknown: Linker sequence
THRNK

SEQ ID NO: 1585 - protein, 12 aa, Unknown
  Description of Unknown: Linker sequence
IDHVLGVPYTTV

SEQ ID NO: 1586 - protein, 4 aa, Unknown
  Description of Unknown: Linker sequence
IDGR

SEQ ID NO: 1587 - protein, 4 aa, Unknown
  Description of Unknown: Linker sequence
KGTQ

SEQ ID NO: 1588 - protein, 5 aa, Unknown
  Description of Unknown: Linker sequence
ETIKG

SEQ ID NO: 1589 - protein, 6 aa, Unknown
  Description of Unknown: Linker sequence
ECSSES

SEQ ID NO: 1590 - protein, 7 aa, Unknown
  Description of Unknown: Linker sequence
LDPTKTI

SEQ ID NO: 1591 - protein, 8 aa, Unknown
  Description of Unknown: Linker sequence
SKPEAEET

SEQ ID NO: 1592 - protein, 10 aa, Unknown
  Description of Unknown: Linker sequence
ETAVTQTYGG

SEQ ID NO: 1593 - protein, 11 aa, Unknown
  Description of Unknown: Linker sequence
FCTDHTVLVQT

SEQ ID NO: 1594 - protein, 4 aa, Unknown
  Description of Unknown: Linker sequence
SGGT

SEQ ID NO: 1595 - protein, 6 aa, Unknown
  Description of Unknown: Linker sequence
FNENGI

SEQ ID NO: 1596 - protein, 6 aa, Unknown
  Description of Unknown: Linker sequence
SFLNSM

SEQ ID NO: 1597 - protein, 7 aa, Unknown
  Description of Unknown: Linker sequence
QNTGANN

SEQ ID NO: 1598 - protein, 9 aa, Unknown
  Description of Unknown: Linker sequence
QNGYKPGDL

SEQ ID NO: 1599 - protein, 12 aa, Unknown
  Description of Unknown: Linker sequence
TTGTINGATAAT

SEQ ID NO: 1600 - protein, 15 aa, Unknown
  Description of Unknown: Linker sequence
DSSDPAATAPTTAST

SEQ ID NO: 1601 - protein, 11 aa, Unknown
  Description of Unknown: Linker sequence
AEQPGGWKGWR

SEQ ID NO: 1602 - protein, 4 aa, Unknown
  Description of Unknown: Linker sequence
GGGS

SEQ ID NO: 1603 - protein, 4 aa, Unknown
  Description of Unknown: Linker sequence
GGGG

SEQ ID NO: 1604 - protein, 5 aa, Unknown
  Description of Unknown: Linker sequence
GGGGS

SEQ ID NO: 1605 - protein, 6 aa, Unknown
  Description of Unknown: Linker sequence
GGGGGG

SEQ ID NO: 1606 - protein, 8 aa, Unknown
  Description of Unknown: Linker sequence
GGGGGGGG

SEQ ID NO: 1607 - protein, 10 aa, Unknown
  Description of Unknown: Linker sequence
GGGGSGGGGS

SEQ ID NO: 1608 - protein, 12 aa, Unknown
  Description of Unknown: Linker sequence
GSAGSAAGSGEF

SEQ ID NO: 1609 - protein, 14 aa, Unknown
  Description of Unknown: Linker sequence
EGKSSGSGSESKST

SEQ ID NO: 1610 - protein, 15 aa, Unknown
  Description of Unknown: Linker sequence
GGGGSGGGGSGGGGS

SEQ ID NO: 1611 - protein, 18 aa, Unknown
  Description of Unknown: Linker sequence
KESGSVSSEQLAQFRSLD

SEQ ID NO: 1612 - protein, 20 aa, Unknown
  Description of Unknown: Linker sequence
NSGAGSGGSSGSDGASGSRD

SEQ ID NO: 1613 - protein, 20 aa, Unknown
  Description of Unknown: Linker sequence
GGGGSGGGGSGGGGSGGGGS

SEQ ID NO: 1614 - protein, 36 aa, Unknown
  Description of Unknown: Linker sequence
GGSGGGSEGGGSEGGGSEGGGSEGGGSEGGGSGGGS

SEQ ID NO: 1615 - protein, 36 aa, Unknown
  Description of Unknown: Linker sequence
GGSAGGSGSGSSGGSSGASGTGTAGGTGSGSGTGSG

SEQ ID NO: 1616 - protein, 7 aa, Unknown
  Description of Unknown: Linker sequence
VYRFDKE

SEQ ID NO: 1617 - protein, 4 aa, Unknown
  Description of Unknown: Linker sequence
DAHG

SEQ ID NO: 1618 - protein, 4 aa, Unknown
  Description of Unknown: Linker sequence
KGAL

SEQ ID NO: 1619 - protein, 5 aa, Unknown
  Description of Unknown: Linker sequence
RGVEW

SEQ ID NO: 1620 - protein, 6 aa, Unknown
  Description of Unknown: Linker sequence
VTDHDW

SEQ ID NO: 1621 - protein, 7 aa, Unknown
  Description of Unknown: Linker sequence
SGLEVSE

SEQ ID NO: 1622 - protein, 8 aa, Unknown
  Description of Unknown: Linker sequence
LPLPLVPQ

SEQ ID NO: 1623 - protein, 8 aa, Unknown
  Description of Unknown: Linker sequence
VGEPEMPS

SEQ ID NO: 1624 - protein, 9 aa, Unknown
  Description of Unknown: Linker sequence
SAILPGRFQ

SEQ ID NO: 1625 - protein, 18 aa, Unknown
  Description of Unknown: Linker sequence
QGKCKKTCRDVFCPGSST

SEQ ID NO: 1626 - protein, 4 aa, Unknown
  Description of Unknown: Linker sequence
EEGL

SEQ ID NO: 1627 - protein, 4 aa, Unknown
  Description of Unknown: Linker sequence
FAGY

SEQ ID NO: 1628 - protein, 6 aa, Unknown
  Description of Unknown: Linker sequence
NKETRK

SEQ ID NO: 1629 - protein, 7 aa, Unknown
  Description of Unknown: Linker sequence
EKELYFK

SEQ ID NO: 1630 - protein, 7 aa, Unknown
  Description of Unknown: Linker sequence
FQGKIKG

SEQ ID NO: 1631 - protein, 7 aa, Unknown
  Description of Unknown: Linker sequence
MWPDADL

SEQ ID NO: 1632 - protein, 7 aa, Unknown
  Description of Unknown: Linker sequence
VGEGFAF

SEQ ID NO: 1633 - protein, 10 aa, Unknown
  Description of Unknown: Linker sequence
GTARASIPTY

SEQ ID NO: 1634 - protein, 13 aa, Unknown
  Description of Unknown: Linker sequence
FTPVSKDPQSANW

SEQ ID NO: 1635 - protein, 13 aa, Unknown
  Description of Unknown: Linker sequence
YLPKGEDGKDYSW

SEQ ID NO: 1636 - protein, 22 aa, Unknown
  Description of Unknown: Linker sequence
WGFERDENGNPKRDETLKHPRC

SEQ ID NO: 1637 - protein, 55 aa, Unknown
  Description of Unknown: Linker sequence
AYLYGPGREDGPLPEYYEPMECPVIEHPFSKTLHNPTALHFATEEKAVCDPRYPF

SEQ ID NO: 1638 - protein, 44 aa, Unknown
  Description of Unknown: Linker sequence
GRLFAINKMAEGPFPEHYEPIETPLGTNPLHPNVVSNPVVRLYE

SEQ ID NO: 1639 - protein, 4 aa, Unknown
  Description of Unknown: Linker sequence
AAQK

SEQ ID NO: 1640 - protein, 4 aa, Unknown
  Description of Unknown: Linker sequence
EDGL

SEQ ID NO: 1641 - protein, 4 aa, Unknown
  Description of Unknown: Linker sequence
FSGY

SEQ ID NO: 1642 - protein, 5 aa, Unknown
  Description of Unknown: Linker sequence
TNASL

SEQ ID NO: 1643 - protein, 6 aa, Unknown
  Description of Unknown: Linker sequence
DAEKRQ

SEQ ID NO: 1644 - protein, 7 aa, Unknown
  Description of Unknown: Linker sequence
DEGKVTG

SEQ ID NO: 1645 - protein, 7 aa, Unknown
  Description of Unknown: Linker sequence
ENNKINA

SEQ ID NO: 1646 - protein, 7 aa, Unknown
  Description of Unknown: Linker sequence
VRDDFAF

SEQ ID NO: 1647 - protein, 10 aa, Unknown
  Description of Unknown: Linker sequence
TLPSEKQVDL

SEQ ID NO: 1648 - protein, 11 aa, Unknown
  Description of Unknown: Linker sequence
WLPKWDQTYDV

SEQ ID NO: 1649 - protein, 12 aa, Unknown
  Description of Unknown: Linker sequence
ALRMGKKEQFPY

SEQ ID NO: 1650 - protein, 13 aa, Unknown
  Description of Unknown: Linker sequence
NTPKATLADQVNY

SEQ ID NO: 1651 - protein, 27 aa, Unknown
  Description of Unknown: Linker sequence
YDKSSWNYQLDENGYAKRDETLTHPRC

SEQ ID NO: 1652 - protein, 9 aa, Unknown
  Description of Unknown: Linker sequence
HLPATIGDY

SEQ ID NO: 1653 - protein, 4 aa, Unknown
  Description of Unknown: Linker sequence
SNRG

SEQ ID NO: 1654 - protein, 6 aa, Unknown
  Description of Unknown: Linker sequence
DAVKGK

SEQ ID NO: 1655 - protein, 7 aa, Unknown
  Description of Unknown: Linker sequence
LLPDGRV

SEQ ID NO: 1656 - protein, 7 aa, Unknown
  Description of Unknown: Linker sequence
MDGNGQI

SEQ ID NO: 1657 - protein, 7 aa, Unknown
  Description of Unknown: Linker sequence
QAGPSTA

SEQ ID NO: 1658 - protein, 7 aa, Unknown
  Description of Unknown: Linker sequence
SDNHAWL

SEQ ID NO: 1659 - protein, 7 aa, Unknown
  Description of Unknown: Linker sequence
VLPDGST

SEQ ID NO: 1660 - protein, 7 aa, Unknown
  Description of Unknown: Linker sequence
YNSNGNL

SEQ ID NO: 1661 - protein, 7 aa, Unknown
  Description of Unknown: Linker sequence
YTSGSGD

SEQ ID NO: 1662 - protein, 8 aa, Unknown
  Description of Unknown: Linker sequence
DLPIVPAA

SEQ ID NO: 1663 - protein, 8 aa, Unknown
  Description of Unknown: Linker sequence
IEPTSGRV

SEQ ID NO: 1664 - protein, 8 aa, Unknown
  Description of Unknown: Linker sequence
WDPSTGIV

SEQ ID NO: 1665 - protein, 9 aa, Unknown
  Description of Unknown: Linker sequence
EANGQPWTS

SEQ ID NO: 1666 - protein, 9 aa, Unknown
  Description of Unknown: Linker sequence
MLTADKQGL

SEQ ID NO: 1667 - protein, 9 aa, Unknown
  Description of Unknown: Linker sequence
VAPDAMCGN

SEQ ID NO: 1668 - protein, 10 aa, Unknown
  Description of Unknown: Linker sequence
TLGEPGTSPN

SEQ ID NO: 1669 - protein, 12 aa, Unknown
  Description of Unknown: Linker sequence
VTVTKHDMFCPG

SEQ ID NO: 1670 - protein, 13 aa, Unknown
  Description of Unknown: Linker sequence
KQNPNSIVRVYHS

SEQ ID NO: 1671 - protein, 14 aa, Unknown
  Description of Unknown: Linker sequence
FASNGLYFARTFHT

SEQ ID NO: 1672 - protein, 14 aa, Unknown
  Description of Unknown: Linker sequence
GGGLCGDCTTNHFD

SEQ ID NO: 1673 - protein, 14 aa, Unknown
  Description of Unknown: Linker sequence
QASSYTAPQPGLGR

SEQ ID NO: 1674 - protein, 16 aa, Unknown
  Description of Unknown: Linker sequence
FGGSPDYQDSDATTNA

SEQ ID NO: 1675 - protein, 17 aa, Unknown
  Description of Unknown: Linker sequence
WSSYRNDAFGGSPGGIT

SEQ ID NO: 1676 - protein, 20 aa, Unknown
  Description of Unknown: Linker sequence
TGGQRRGIPFEDSTPVFTPE

SEQ ID NO: 1677 - protein, 10 aa, Unknown
  Description of Unknown: Linker sequence
LIPQHTGTFR

SEQ ID NO: 1678 - protein, 11 aa, Unknown
  Description of Unknown: Linker sequence
EPRSQPHTKPS

SEQ ID NO: 1679 - protein, 4 aa, Unknown
  Description of Unknown: Linker sequence
KPAP

SEQ ID NO: 1680 - protein, 6 aa, Unknown
  Description of Unknown: Linker sequence
IEGANG

SEQ ID NO: 1681 - protein, 8 aa, Unknown
  Description of Unknown: Linker sequence
PIKNMPID

SEQ ID NO: 1682 - protein, 12 aa, Unknown
  Description of Unknown: Linker sequence
DQPTAHPTVRDE

SEQ ID NO: 1683 - protein, 8 aa, Unknown
  Description of Unknown: Linker sequence
LVRTLVPT

SEQ ID NO: 1684 - protein, 9 aa, Unknown
  Description of Unknown: Linker sequence
AGAPVETPQ

SEQ ID NO: 1685 - protein, 11 aa, Unknown
  Description of Unknown: Linker sequence
SLDAPATSLTG

SEQ ID NO: 1686 - protein, 12 aa, Unknown
  Description of Unknown: Linker sequence
YAAGTPLSSPEL

SEQ ID NO: 1687 - protein, 4 aa, Unknown
  Description of Unknown: Linker sequence
KVEH

SEQ ID NO: 1688 - protein, 4 aa, Unknown
  Description of Unknown: Linker sequence
SHGQ

SEQ ID NO: 1689 - protein, 4 aa, Unknown
  Description of Unknown: Linker sequence
VDLS

SEQ ID NO: 1690 - protein, 5 aa, Unknown
  Description of Unknown: Linker sequence
KGLDA

SEQ ID NO: 1691 - protein, 5 aa, Unknown
  Description of Unknown: Linker sequence
LGPNA

SEQ ID NO: 1692 - protein, 5 aa, Unknown
  Description of Unknown: Linker sequence
LTGRI

SEQ ID NO: 1693 - protein, 6 aa, Unknown
  Description of Unknown: Linker sequence
ITRRSV

SEQ ID NO: 1694 - protein, 6 aa, Unknown
  Description of Unknown: Linker sequence
VKRQDI

SEQ ID NO: 1695 - protein, 7 aa, Unknown
  Description of Unknown: Linker sequence
FDKTGAE

SEQ ID NO: 1696 - protein, 17 aa, Unknown
  Description of Unknown: Linker sequence
ESNLQYDAGDKGIYRHY

SEQ ID NO: 1697 - protein, 5 aa, Unknown
  Description of Unknown: Linker sequence
DIGTI

SEQ ID NO: 1698 - protein, 27 aa, Unknown
  Description of Unknown: Linker sequence
TKKPVPDFSFYDRSAPIYTQPRYLPPS

SEQ ID NO: 1699 - protein, 4 aa, Unknown
  Description of Unknown: Linker sequence
KTPL

SEQ ID NO: 1700 - protein, 7 aa, Unknown
  Description of Unknown: Linker sequence
NCYGCET

SEQ ID NO: 1701 - protein, 16 aa, Unknown
  Description of Unknown: Linker sequence
YGIDVKIPEGLEPPNE

SEQ ID NO: 1702 - protein, 6 aa, Unknown
  Description of Unknown: Linker sequence
VGGFYN

SEQ ID NO: 1703 - protein, 7 aa, Unknown
  Description of Unknown: Linker sequence
VLTGKAR

SEQ ID NO: 1704 - protein, 14 aa, Unknown
  Description of Unknown: Linker sequence
FDVAESVIPSSGTF

SEQ ID NO: 1705 - protein, 5 aa, Unknown
  Description of Unknown: Linker sequence
TLKPW

SEQ ID NO: 1706 - protein, 9 aa, Unknown
  Description of Unknown: Linker sequence
VQNTTHLDE

SEQ ID NO: 1707 - protein, 11 aa, Unknown
  Description of Unknown: Linker sequence
LKGEPSDMDKA

SEQ ID NO: 1708 - protein, 14 aa, Unknown
  Description of Unknown: Linker sequence
HFPAMVSRISGIGL

SEQ ID NO: 1709 - protein, 15 aa, Unknown
  Description of Unknown: Linker sequence
QVSRGAEHLDDLDLN

SEQ ID NO: 1710 - protein, 26 aa, Unknown
  Description of Unknown: Linker sequence
LAQVDPGENARYCTLQGRNEVPDTLD

SEQ ID NO: 1711 - protein, 27 aa, Unknown
  Description of Unknown: Linker sequence
YNEEVVALPVGGFYRFRKSGDRHGWEG

SEQ ID NO: 1712 - protein, 13 aa, Unknown
  Description of Unknown: Linker sequence
HDPFTLEPYSRDP

SEQ ID NO: 1713 - protein, 13 aa, Unknown
  Description of Unknown: Linker sequence
YTPAGEPIPTNKR

SEQ ID NO: 1714 - protein, 4 aa, Unknown
  Description of Unknown: Linker sequence
NIPP

SEQ ID NO: 1715 - protein, 4 aa, Unknown
  Description of Unknown: Linker sequence
RGWA

SEQ ID NO: 1716 - protein, 5 aa, Unknown
  Description of Unknown: Linker sequence
AFETP

SEQ ID NO: 1717 - protein, 5 aa, Unknown
  Description of Unknown: Linker sequence
DELRG

SEQ ID NO: 1718 - protein, 6 aa, Unknown
  Description of Unknown: Linker sequence
EIPDVV

SEQ ID NO: 1719 - protein, 7 aa, Unknown
  Description of Unknown: Linker sequence
KGGYDGR

SEQ ID NO: 1720 - protein, 7 aa, Unknown
  Description of Unknown: Linker sequence
RRGEPHV

SEQ ID NO: 1721 - protein, 8 aa, Unknown
  Description of Unknown: Linker sequence
LKVPRPGT

SEQ ID NO: 1722 - protein, 14 aa, Unknown
  Description of Unknown: Linker sequence
NLDGKPLLTGKRNP

SEQ ID NO: 1723 - protein, 6 aa, Unknown
  Description of Unknown: Linker sequence
DHSDVA

SEQ ID NO: 1724 - protein, 8 aa, Unknown
  Description of Unknown: Linker sequence
FKPAYGSI

SEQ ID NO: 1725 - protein, 19 aa, Unknown
  Description of Unknown: Linker sequence
AFPGTPHLLPPANSGDADA

SEQ ID NO: 1726 - protein, 12 aa, Unknown
  Description of Unknown: Linker sequence
YGKDDKLYPKDP

SEQ ID NO: 1727 - protein, 9 aa, Unknown
  Description of Unknown: Linker sequence
KYNLYGKDI

SEQ ID NO: 1728 - protein, 6 aa, Unknown
  Description of Unknown: Linker sequence
LREGNL

SEQ ID NO: 1729 - protein, 6 aa, Unknown
  Description of Unknown: Linker sequence
DCNEKL

SEQ ID NO: 1730 - protein, 6 aa, Unknown
  Description of Unknown: Linker sequence
LYPSDP

SEQ ID NO: 1731 - protein, 6 aa, Unknown
  Description of Unknown: Linker sequence
YGAHDA

SEQ ID NO: 1732 - protein, 9 aa, Unknown
  Description of Unknown: Linker sequence
QFKMMGETD

SEQ ID NO: 1733 - protein, 6 aa, Unknown
  Description of Unknown: Linker sequence
FETEYF

SEQ ID NO: 1734 - protein, 11 aa, Unknown
  Description of Unknown: Linker sequence
TSPHDHQTHAY

SEQ ID NO: 1735 - protein, 9 aa, Unknown
  Description of Unknown: Linker sequence
KADPKGITE

SEQ ID NO: 1736 - protein, 34 aa, Unknown
  Description of Unknown: Linker sequence
LTAKEPTEVESVECPHIAVGVWEANEKLPETPDR

SEQ ID NO: 1737 - protein, 4 aa, Unknown
  Description of Unknown: Linker sequence
VVPN

SEQ ID NO: 1738 - protein, 5 aa, Unknown
  Description of Unknown: Linker sequence
LSPPV

SEQ ID NO: 1739 - protein, 7 aa, Unknown
  Description of Unknown: Linker sequence
DVKNGEC

SEQ ID NO: 1740 - protein, 7 aa, Unknown
  Description of Unknown: Linker sequence
KDDIVDR

SEQ ID NO: 1741 - protein, 7 aa, Unknown
  Description of Unknown: Linker sequence
SDKKCSV

SEQ ID NO: 1742 - protein, 7 aa, Unknown
  Description of Unknown: Linker sequence
TKVPLVA

SEQ ID NO: 1743 - protein, 9 aa, Unknown
  Description of Unknown: Linker sequence
LAQLDNYGQ

SEQ ID NO: 1744 - protein, 12 aa, Unknown
  Description of Unknown: Linker sequence
NYNVKSPITGND

SEQ ID NO: 1745 - protein, 85 aa, Unknown
  Description of Unknown: Linker sequence
KPLKEPKTVNVVQFEPSKGAIGKAYKKDAKLVMEYLAICDECYITEMEMLLNEKGEFTIETEGKTFQLTKDMINVKRFQKTLYVE

SEQ ID NO: 1746 - protein, 4 aa, Unknown
  Description of Unknown: Linker sequence
SNGG

SEQ ID NO: 1747 - protein, 13 aa, Unknown
  Description of Unknown: Linker sequence
FSVDEIVQPDPPI

SEQ ID NO: 1748 - protein, 10 aa, Unknown
  Description of Unknown: Linker sequence
LTPRRSRKLK

SEQ ID NO: 1749 - protein, 6 aa, Unknown
  Description of Unknown: Linker sequence
DEPRSV

SEQ ID NO: 1750 - protein, 29 aa, Unknown
  Description of Unknown: Linker sequence
LPTANGDGGALALDSLTVLGAGGNNANDW

SEQ ID NO: 1751 - protein, 6 aa, Unknown
  Description of Unknown: Linker sequence
RNNLTR

SEQ ID NO: 1752 - protein, 8 aa, Unknown
  Description of Unknown: Linker sequence
RAMTDVHQ

SEQ ID NO: 1753 - protein, 24 aa, Unknown
  Description of Unknown: Linker sequence
TTENPELQLEPLSAPEVTEPTATD

SEQ ID NO: 1754 - protein, 6 aa, Unknown
  Description of Unknown: Linker sequence
VPRDCG

SEQ ID NO: 1755 - protein, 7 aa, Unknown
  Description of Unknown: Linker sequence
VRSRGPE

SEQ ID NO: 1756 - protein, 40 aa, Unknown
  Description of Unknown: Linker sequence
QEPEFQRMSALRLAACKRKEQEHGKDRGNTPKKPRLVFTD

SEQ ID NO: 1757 - protein, 14 aa, Unknown
  Description of Unknown: Linker sequence
AEGFGLPEEKGPDL

SEQ ID NO: 1758 - protein, 4 aa, Unknown
  Description of Unknown: Linker sequence
KGGK

SEQ ID NO: 1759 - protein, 6 aa, Unknown
  Description of Unknown: Linker sequence
KNQKPI

SEQ ID NO: 1760 - protein, 7 aa, Unknown
  Description of Unknown: Linker sequence
RGTLNVS

SEQ ID NO: 1761 - protein, 9 aa, Unknown
  Description of Unknown: Linker sequence
TVGAGLPII

SEQ ID NO: 1762 - protein, 4 aa, Unknown
  Description of Unknown: Linker sequence
LDGE

SEQ ID NO: 1763 - protein, 4 aa, Unknown
  Description of Unknown: Linker sequence
LGNW

SEQ ID NO: 1764 - protein, 7 aa, Unknown
  Description of Unknown: Linker sequence
HLFPDCA

SEQ ID NO: 1765 - protein, 18 aa, Unknown
  Description of Unknown: Linker sequence
IPKAELLTSESRGVLPDT

SEQ ID NO: 1766 - protein, 5 aa, Unknown
  Description of Unknown: Linker sequence
ETVAP

SEQ ID NO: 1767 - protein, 6 aa, Unknown
  Description of Unknown: Linker sequence
QGLTSF

SEQ ID NO: 1768 - protein, 7 aa, Unknown
  Description of Unknown: Linker sequence
VSKPKME

SEQ ID NO: 1769 - protein, 5 aa, Unknown
  Description of Unknown: Linker sequence
TVAAP

SEQ ID NO: 1770 - protein, 26 aa, Unknown
  Description of Unknown: Linker sequence
GGNPPGGNRGTTTTRRPATTTGSSPG

SEQ ID NO: 1771 - protein, 7 aa, Unknown
  Description of Unknown: Linker sequence
CKPCICT

SEQ ID NO: 1772 - protein, 6 aa, Unknown
  Description of Unknown: Linker sequence
VPSEVS

SEQ ID NO: 1773 - protein, 10 aa, Unknown
  Description of Unknown: Linker sequence
EPKSCDKTHT

SEQ ID NO: 1774 - protein, 7 aa, Unknown
  Description of Unknown: Linker sequence
CPPCKCP

SEQ ID NO: 1775 - protein, 9 aa, Unknown
  Description of Unknown: Linker sequence
EPRGPTIKP

SEQ ID NO: 1776 - protein, 5 aa, Unknown
  Description of Unknown: Linker sequence
ATENE

SEQ ID NO: 1777 - protein, 6 aa, Unknown
  Description of Unknown: Linker sequence
AKSVGI

SEQ ID NO: 1778 - protein, 7 aa, Unknown
  Description of Unknown: Linker sequence
ATWTGDS

SEQ ID NO: 1779 - protein, 10 aa, Unknown
  Description of Unknown: Linker sequence
ATITNANWDD

SEQ ID NO: 1780 - protein, 11 aa, Unknown
  Description of Unknown: Linker sequence
NGKDFSEPLPE

SEQ ID NO: 1781 - protein, 6 aa, Unknown
  Description of Unknown: Linker sequence
KQPLRR

SEQ ID NO: 1782 - protein, 8 aa, Unknown
  Description of Unknown: Linker sequence
LSPYTESS

SEQ ID NO: 1783 - protein, 4 aa, Unknown
  Description of Unknown: Linker sequence
VDSE

SEQ ID NO: 1784 - protein, 5 aa, Unknown
  Description of Unknown: Linker sequence
FVTGP

SEQ ID NO: 1785 - protein, 7 aa, Unknown
  Description of Unknown: Linker sequence
IKGDAYY

SEQ ID NO: 1786 - protein, 8 aa, Unknown
  Description of Unknown: Linker sequence
TKSGVVHF

SEQ ID NO: 1787 - protein, 9 aa, Unknown
  Description of Unknown: Linker sequence
VVLGEEVSF

SEQ ID NO: 1788 - protein, 12 aa, Unknown
  Description of Unknown: Linker sequence
IVPNDAAKPYNM

SEQ ID NO: 1789 - protein, 26 aa, Unknown
  Description of Unknown: Linker sequence
YLPSNNMEEPPYIDTGDPADRDATGV

SEQ ID NO: 1790 - protein, 4 aa, Unknown
  Description of Unknown: Linker sequence
GALP

SEQ ID NO: 1791 - protein, 8 aa, Unknown
  Description of Unknown: Linker sequence
FGVDWLKG

SEQ ID NO: 1792 - protein, 4 aa, Unknown
  Description of Unknown: Linker sequence
ILPQ

SEQ ID NO: 1793 - protein, 7 aa, Unknown
  Description of Unknown: Linker sequence
EAPLDNS

SEQ ID NO: 1794 - protein, 14 aa, Unknown
  Description of Unknown: Linker sequence
AAERVPLANPFAGE

SEQ ID NO: 1795 - protein, 4 aa, Unknown
  Description of Unknown: Linker sequence
EGVL

SEQ ID NO: 1796 - protein, 6 aa, Unknown
  Description of Unknown: Linker sequence
LVKIEP

SEQ ID NO: 1797 - protein, 6 aa, Unknown
  Description of Unknown: Linker sequence
RSLIGD

SEQ ID NO: 1798 - protein, 7 aa, Unknown
  Description of Unknown: Linker sequence
DASAVHP

SEQ ID NO: 1799 - protein, 7 aa, Unknown
  Description of Unknown: Linker sequence
EFPELDV

SEQ ID NO: 1800 - protein, 7 aa, Unknown
  Description of Unknown: Linker sequence
FSDYFEH

SEQ ID NO: 1801 - protein, 7 aa, Unknown
  Description of Unknown: Linker sequence
KVSRLGE

SEQ ID NO: 1802 - protein, 7 aa, Unknown
  Description of Unknown: Linker sequence
NGAFRTR

SEQ ID NO: 1803 - protein, 7 aa, Unknown
  Description of Unknown: Linker sequence
PLKSAPS

SEQ ID NO: 1804 - protein, 8 aa, Unknown
  Description of Unknown: Linker sequence
ARISGLNS

SEQ ID NO: 1805 - protein, 10 aa, Unknown
  Description of Unknown: Linker sequence
QRIAADTERD

SEQ ID NO: 1806 - protein, 11 aa, Unknown
  Description of Unknown: Linker sequence
ERFGLSNQGRA

SEQ ID NO: 1807 - protein, 11 aa, Unknown
  Description of Unknown: Linker sequence
LLAAPAGPRAT

SEQ ID NO: 1808 - protein, 12 aa, Unknown
  Description of Unknown: Linker sequence
KVGEEAPGTLHP

SEQ ID NO: 1809 - protein, 12 aa, Unknown
  Description of Unknown: Linker sequence
NAVGVDVNTASA

SEQ ID NO: 1810 - protein, 13 aa, Unknown
  Description of Unknown: Linker sequence
AAGFLRVMNGDNP

SEQ ID NO: 1811 - protein, 13 aa, Unknown
  Description of Unknown: Linker sequence
GVESLKDLKPGMV

SEQ ID NO: 1812 - protein, 13 aa, Unknown
  Description of Unknown: Linker sequence
SIGVGQYQHDVSQ

SEQ ID NO: 1813 - protein, 17 aa, Unknown
  Description of Unknown: Linker sequence
LDKPGRDPRPEFKTAEF

SEQ ID NO: 1814 - protein, 23 aa, Unknown
  Description of Unknown: Linker sequence
LKRLDPKKFTDETFGLPTVTDIL

SEQ ID NO: 1815 - protein, 4 aa, Unknown
  Description of Unknown: Linker sequence
LEGE

SEQ ID NO: 1816 - protein, 5 aa, Unknown
  Description of Unknown: Linker sequence
RLGFK

SEQ ID NO: 1817 - protein, 9 aa, Unknown
  Description of Unknown: Linker sequence
RGRPFEPPV

SEQ ID NO: 1818 - protein, 15 aa, Unknown
  Description of Unknown: Linker sequence
RGEVEETLKEDLPNV

SEQ ID NO: 1819 - protein, 4 aa, Unknown
  Description of Unknown: Linker sequence
LEYE

SEQ ID NO: 1820 - protein, 9 aa, Unknown
  Description of Unknown: Linker sequence
SYGLPPLNA

SEQ ID NO: 1821 - protein, 5 aa, Unknown
  Description of Unknown: Linker sequence
ILHDE

SEQ ID NO: 1822 - protein, 13 aa, Unknown
  Description of Unknown: Linker sequence
KGWGGLPIGTEGR

SEQ ID NO: 1823 - protein, 4 aa, Unknown
  Description of Unknown: Linker sequence
PQSP

SEQ ID NO: 1824 - protein, 6 aa, Unknown
  Description of Unknown: Linker sequence
DGFEAL

SEQ ID NO: 1825 - protein, 6 aa, Unknown
  Description of Unknown: Linker sequence
EQNPWK

SEQ ID NO: 1826 - protein, 6 aa, Unknown
  Description of Unknown: Linker sequence
SEHWQR

SEQ ID NO: 1827 - protein, 9 aa, Unknown
  Description of Unknown: Linker sequence
LDPQACPTV

SEQ ID NO: 1828 - protein, 5 aa, Unknown
  Description of Unknown: Linker sequence
KTPLT

SEQ ID NO: 1829 - protein, 6 aa, Unknown
  Description of Unknown: Linker sequence
LRQLTT

SEQ ID NO: 1830 - protein, 4 aa, Unknown
  Description of Unknown: Linker sequence
QNDI

SEQ ID NO: 1831 - protein, 7 aa, Unknown
  Description of Unknown: Linker sequence
INARAPV

SEQ ID NO: 1832 - protein, 9 aa, Unknown
  Description of Unknown: Linker sequence
TVTHGDIDL

SEQ ID NO: 1833 - protein, 10 aa, Unknown
  Description of Unknown: Linker sequence
TKTDVAGEAE

SEQ ID NO: 1834 - protein, 24 aa, Unknown
  Description of Unknown: Linker sequence
LFNTNGFMLEENVVSTKPRFHFIA

SEQ ID NO: 1835 - protein, 7 aa, Unknown
  Description of Unknown: Linker sequence
ASLDQPF

SEQ ID NO: 1836 - protein, 9 aa, Unknown
  Description of Unknown: Linker sequence
VKPGRQYQE

SEQ ID NO: 1837 - protein, 4 aa, Unknown
  Description of Unknown: Linker sequence
DGFE

SEQ ID NO: 1838 - protein, 5 aa, Unknown
  Description of Unknown: Linker sequence
LRRFN

SEQ ID NO: 1839 - protein, 6 aa, Unknown
  Description of Unknown: Linker sequence
KRTGET

SEQ ID NO: 1840 - protein, 16 aa, Unknown
  Description of Unknown: Linker sequence
VEGEQSIPMVSRLGMK

SEQ ID NO: 1841 - protein, 22 aa, Unknown
  Description of Unknown: Linker sequence
AEGHITTNHVAATRAAKSKVRR

SEQ ID NO: 1842 - protein, 8 aa, Unknown
  Description of Unknown: Linker sequence
VDKSDEPL

SEQ ID NO: 1843 - protein, 7 aa, Unknown
  Description of Unknown: Linker sequence
IVSPANE

SEQ ID NO: 1844 - protein, 11 aa, Unknown
  Description of Unknown: Linker sequence
VENEPNLCYNA

SEQ ID NO: 1845 - protein, 13 aa, Unknown
  Description of Unknown: Linker sequence
FITLEENKPTRPV

SEQ ID NO: 1846 - protein, 4 aa, Unknown
  Description of Unknown: Linker sequence
EDGI

SEQ ID NO: 1847 - protein, 4 aa, Unknown
  Description of Unknown: Linker sequence
HKLK

SEQ ID NO: 1848 - protein, 4 aa, Unknown
  Description of Unknown: Linker sequence
KGGE

SEQ ID NO: 1849 - protein, 4 aa, Unknown
  Description of Unknown: Linker sequence
SHSL

SEQ ID NO: 1850 - protein, 6 aa, Unknown
  Description of Unknown: Linker sequence
WSTDIL

SEQ ID NO: 1851 - protein, 9 aa, Unknown
  Description of Unknown: Linker sequence
DIIKPDPPK

SEQ ID NO: 1852 - protein, 13 aa, Unknown
  Description of Unknown: Linker sequence
KDQKEPKNKTFLR

SEQ ID NO: 1853 - protein, 7 aa, Unknown
  Description of Unknown: Linker sequence
WDNQCQC

SEQ ID NO: 1854 - protein, 42 aa, Unknown
  Description of Unknown: Linker sequence
SSATRSTTKQVTPQPEEQKERKTTEMQSPMQPVDQASLPGHC

SEQ ID NO: 1855 - protein, 5 aa, Unknown
  Description of Unknown: Linker sequence
LNKPI

SEQ ID NO: 1856 - protein, 5 aa, Unknown
  Description of Unknown: Linker sequence
NHQSN

SEQ ID NO: 1857 - protein, 5 aa, Unknown
  Description of Unknown: Linker sequence
NSIDQ

SEQ ID NO: 1858 - protein, 7 aa, Unknown
  Description of Unknown: Linker sequence
YLPNVTK

SEQ ID NO: 1859 - protein, 9 aa, Unknown
  Description of Unknown: Linker sequence
LANLKNLGW

SEQ ID NO: 1860 - protein, 9 aa, Unknown
  Description of Unknown: Linker sequence
LKDLKKLKS

SEQ ID NO: 1861 - protein, 10 aa, Unknown
  Description of Unknown: Linker sequence
FLDENKVKDL

SEQ ID NO: 1862 - protein, 10 aa, Unknown
  Description of Unknown: Linker sequence
NLKKKSVTDA

SEQ ID NO: 1863 - protein, 11 aa, Unknown
  Description of Unknown: Linker sequence
FLNGNKLTDIK

SEQ ID NO: 1864 - protein, 11 aa, Unknown
  Description of Unknown: Linker sequence
PNTVKNTDGSL

SEQ ID NO: 1865 - protein, 11 aa, Unknown
  Description of Unknown: Linker sequence
SLEHNGISDIN

SEQ ID NO: 1866 - protein, 13 aa, Unknown
  Description of Unknown: Linker sequence
IANNSDIKSVQGI

SEQ ID NO: 1867 - protein, 5 aa, Unknown
  Description of Unknown: Linker sequence
FTTLT

SEQ ID NO: 1868 - protein, 5 aa, Unknown
  Description of Unknown: Linker sequence
KAPEV

SEQ ID NO: 1869 - protein, 9 aa, Unknown
  Description of Unknown: Linker sequence
VSDVAVDVV

SEQ ID NO: 1870 - protein, 6 aa, Unknown
  Description of Unknown: Linker sequence
INTSYF

SEQ ID NO: 1871 - protein, 22 aa, Unknown
  Description of Unknown: Linker sequence
SGIISLEDLPDYTRSDEPLNSI

SEQ ID NO: 1872 - protein, 4 aa, Unknown
  Description of Unknown: Linker sequence
VNGQ

SEQ ID NO: 1873 - protein, 5 aa, Unknown
  Description of Unknown: Linker sequence
FKNAT

SEQ ID NO: 1874 - protein, 5 aa, Unknown
  Description of Unknown: Linker sequence
FYPNR

SEQ ID NO: 1875 - protein, 5 aa, Unknown
  Description of Unknown: Linker sequence
MDNDV

SEQ ID NO: 1876 - protein, 6 aa, Unknown
  Description of Unknown: Linker sequence
FPVPTL

SEQ ID NO: 1877 - protein, 6 aa, Unknown
  Description of Unknown: Linker sequence
VNDQGQ

SEQ ID NO: 1878 - protein, 7 aa, Unknown
  Description of Unknown: Linker sequence
SSFTPNV

SEQ ID NO: 1879 - protein, 7 aa, Unknown
  Description of Unknown: Linker sequence
VKGTIAA

SEQ ID NO: 1880 - protein, 8 aa, Unknown
  Description of Unknown: Linker sequence
SKKFPSYS

SEQ ID NO: 1881 - protein, 9 aa, Unknown
  Description of Unknown: Linker sequence
ITYQTYSEV

SEQ ID NO: 1882 - protein, 10 aa, Unknown
  Description of Unknown: Linker sequence
FATDKGFPKT

SEQ ID NO: 1883 - protein, 12 aa, Unknown
  Description of Unknown: Linker sequence
TADPIPDAGRSS

SEQ ID NO: 1884 - protein, 4 aa, Unknown
  Description of Unknown: Linker sequence
EKCF

SEQ ID NO: 1885 - protein, 4 aa, Unknown
  Description of Unknown: Linker sequence
KNGK

SEQ ID NO: 1886 - protein, 5 aa, Unknown
  Description of Unknown: Linker sequence
EKSHM

SEQ ID NO: 1887 - protein, 5 aa, Unknown
  Description of Unknown: Linker sequence
NTNSD

SEQ ID NO: 1888 - protein, 6 aa, Unknown
  Description of Unknown: Linker sequence
NAPEKH

SEQ ID NO: 1889 - protein, 7 aa, Unknown
  Description of Unknown: Linker sequence
ACPVAAL

SEQ ID NO: 1890 - protein, 7 aa, Unknown
  Description of Unknown: Linker sequence
DERSKSL

SEQ ID NO: 1891 - protein, 7 aa, Unknown
  Description of Unknown: Linker sequence
KCLLCGR

SEQ ID NO: 1892 - protein, 7 aa, Unknown
  Description of Unknown: Linker sequence
TETYAMK

SEQ ID NO: 1893 - protein, 9 aa, Unknown
  Description of Unknown: Linker sequence
DTNCLLCGQ

SEQ ID NO: 1894 - protein, 10 aa, Unknown
  Description of Unknown: Linker sequence
NGGGQPHVNP

SEQ ID NO: 1895 - protein, 14 aa, Unknown
  Description of Unknown: Linker sequence
YKARASKPFLPKDK

SEQ ID NO: 1896 - protein, 18 aa, Unknown
  Description of Unknown: Linker sequence
LDIHEFKCGPCNRRENCE

SEQ ID NO: 1897 - protein, 6 aa, Unknown
  Description of Unknown: Linker sequence
VVGGEL

SEQ ID NO: 1898 - protein, 5 aa, Unknown
  Description of Unknown: Linker sequence
HNGFF

SEQ ID NO: 1899 - protein, 11 aa, Unknown
  Description of Unknown: Linker sequence
VKGKEGDEEEE

SEQ ID NO: 1900 - protein, 4 aa, Unknown
  Description of Unknown: Linker sequence
KLIV

SEQ ID NO: 1901 - protein, 6 aa, Unknown
  Description of Unknown: Linker sequence
TIGNRA

SEQ ID NO: 1902 - protein, 13 aa, Unknown
  Description of Unknown: Linker sequence
VPPSKPTVNIPSS

SEQ ID NO: 1903 - protein, 5 aa, Unknown
  Description of Unknown: Linker sequence
FFSIL

SEQ ID NO: 1904 - protein, 6 aa, Unknown
  Description of Unknown: Linker sequence
TTGEWK

SEQ ID NO: 1905 - protein, 7 aa, Unknown
  Description of Unknown: Linker sequence
MSTEEAE

SEQ ID NO: 1906 - protein, 8 aa, Unknown
  Description of Unknown: Linker sequence
ASQVESDW

SEQ ID NO: 1907 - protein, 7 aa, Unknown
  Description of Unknown: Linker sequence
KLHLSNC

SEQ ID NO: 1908 - protein, 4 aa, Unknown
  Description of Unknown: Linker sequence
DANF

SEQ ID NO: 1909 - protein, 7 aa, Unknown
  Description of Unknown: Linker sequence
VGLEKNA

SEQ ID NO: 1910 - protein, 8 aa, Unknown
  Description of Unknown: Linker sequence
TNSTEETL

SEQ ID NO: 1911 - protein, 9 aa, Unknown
  Description of Unknown: Linker sequence
KTWENVNAQ

SEQ ID NO: 1912 - protein, 9 aa, Unknown
  Description of Unknown: Linker sequence
YLPTLYVSQ

SEQ ID NO: 1913 - protein, 11 aa, Unknown
  Description of Unknown: Linker sequence
SHRYGFGKIDA

SEQ ID NO: 1914 - protein, 12 aa, Unknown
  Description of Unknown: Linker sequence
GDWRDSAMGKKY

SEQ ID NO: 1915 - protein, 4 aa, Unknown
  Description of Unknown: Linker sequence
KGTL

SEQ ID NO: 1916 - protein, 7 aa, Unknown
  Description of Unknown: Linker sequence
KLNKDIV

SEQ ID NO: 1917 - protein, 8 aa, Unknown
  Description of Unknown: Linker sequence
ETRKRALS

SEQ ID NO: 1918 - protein, 33 aa, Unknown
  Description of Unknown: Linker sequence
VYPPDYNPEGKVTKRKHDNEGSGSKRPKVEYSE

SEQ ID NO: 1919 - protein, 8 aa, Unknown
  Description of Unknown: Linker sequence
IERHSIHW

SEQ ID NO: 1920 - protein, 9 aa, Unknown
  Description of Unknown: Linker sequence
DLTGTPLFV

SEQ ID NO: 1921 - protein, 10 aa, Unknown
  Description of Unknown: Linker sequence
NGPASLPYDI

SEQ ID NO: 1922 - protein, 14 aa, Unknown
  Description of Unknown: Linker sequence
VNGSDINVDWGKPI

SEQ ID NO: 1923 - protein, 44 aa, Unknown
  Description of Unknown: Linker sequence
YAGAPGGLPTDEGTPPVDHQCLDTLDVRPVVPRSVPVNSFVKRP

SEQ ID NO: 1924 - protein, 6 aa, Unknown
  Description of Unknown: Linker sequence
QFGRKG

SEQ ID NO: 1925 - protein, 9 aa, Unknown
  Description of Unknown: Linker sequence
IASGAIGGL

SEQ ID NO: 1926 - protein, 4 aa, Unknown
  Description of Unknown: Linker sequence
SGNP

SEQ ID NO: 1927 - protein, 6 aa, Unknown
  Description of Unknown: Linker sequence
VTGISP

SEQ ID NO: 1928 - protein, 6 aa, Unknown
  Description of Unknown: Linker sequence
IKRADA

SEQ ID NO: 1929 - protein, 7 aa, Unknown
  Description of Unknown: Linker sequence
VQPKLTA

SEQ ID NO: 1930 - protein, 14 aa, Unknown
  Description of Unknown: Linker sequence
TGVMKNDTNENLKK

SEQ ID NO: 1931 - protein, 24 aa, Unknown
  Description of Unknown: Linker sequence
FLPRVGVGTSFGLPQTRRISLASP

SEQ ID NO: 1932 - protein, 4 aa, Unknown
  Description of Unknown: Linker sequence
ASNM

SEQ ID NO: 1933 - protein, 6 aa, Unknown
  Description of Unknown: Linker sequence
ESKPSV

SEQ ID NO: 1934 - protein, 7 aa, Unknown
  Description of Unknown: Linker sequence
IKMLGSK

SEQ ID NO: 1935 - protein, 7 aa, Unknown
  Description of Unknown: Linker sequence
LRREPNL

SEQ ID NO: 1936 - protein, 7 aa, Unknown
  Description of Unknown: Linker sequence
LSRSSNP

SEQ ID NO: 1937 - protein, 8 aa, Unknown
  Description of Unknown: Linker sequence
RLGCRYSK

SEQ ID NO: 1938 - protein, 4 aa, Unknown
  Description of Unknown: Linker sequence
ETPA

SEQ ID NO: 1939 - protein, 8 aa, Unknown
  Description of Unknown: Linker sequence
FANHTYVP

SEQ ID NO: 1940 - protein, 5 aa, Unknown
  Description of Unknown: Linker sequence
LFEWL

SEQ ID NO: 1941 - protein, 14 aa, Unknown
  Description of Unknown: Linker sequence
HELGGKNASGGYGG

SEQ ID NO: 1942 - protein, 5 aa, Unknown
  Description of Unknown: Linker sequence
RGDVG

SEQ ID NO: 1943 - protein, 4 aa, Unknown
  Description of Unknown: Linker sequence
DYTR

SEQ ID NO: 1944 - protein, 8 aa, Unknown
  Description of Unknown: Linker sequence
QTQAVSQQ

SEQ ID NO: 1945 - protein, 8 aa, Unknown
  Description of Unknown: Linker sequence
YTDHQMLV

SEQ ID NO: 1946 - protein, 4 aa, Unknown
  Description of Unknown: Linker sequence
LNNR

SEQ ID NO: 1947 - protein, 12 aa, Unknown
  Description of Unknown: Linker sequence
TCRKTNKLSPYD

SEQ ID NO: 1948 - protein, 5 aa, Unknown
  Description of Unknown: Linker sequence
VVNNV

SEQ ID NO: 1949 - protein, 7 aa, Unknown
  Description of Unknown: Linker sequence
VQARASS

SEQ ID NO: 1950 - protein, 8 aa, Unknown
  Description of Unknown: Linker sequence
TYIPRKEV

SEQ ID NO: 1951 - protein, 10 aa, Unknown
  Description of Unknown: Linker sequence
IQATIIRQNQ

SEQ ID NO: 1952 - protein, 4 aa, Unknown
  Description of Unknown: Linker sequence
KGDD

SEQ ID NO: 1953 - protein, 4 aa, Unknown
  Description of Unknown: Linker sequence
SDVV

SEQ ID NO: 1954 - protein, 6 aa, Unknown
  Description of Unknown: Linker sequence
VAQSSY

SEQ ID NO: 1955 - protein, 8 aa, Unknown
  Description of Unknown: Linker sequence
TSRDYDTQ

SEQ ID NO: 1956 - protein, 11 aa, Unknown
  Description of Unknown: Linker sequence
YAPFLPKTWTS

SEQ ID NO: 1957 - protein, 5 aa, Unknown
  Description of Unknown: Linker sequence
AGVNL

SEQ ID NO: 1958 - protein, 11 aa, Unknown
  Description of Unknown: Linker sequence
TLLLKSPTTHP

SEQ ID NO: 1959 - protein, 5 aa, Unknown
  Description of Unknown: Linker sequence
VESAM

SEQ ID NO: 1960 - protein, 6 aa, Unknown
  Description of Unknown: Linker sequence
GPLWSN

SEQ ID NO: 1961 - protein, 9 aa, Unknown
  Description of Unknown: Linker sequence
QVENTGIHE

SEQ ID NO: 1962 - protein, 8 aa, Unknown
  Description of Unknown: Linker sequence
SCDNLPHN

SEQ ID NO: 1963 - protein, 16 aa, Unknown
  Description of Unknown: Linker sequence
ICDRNHTWLPVSDDAC

SEQ ID NO: 1964 - protein, 4 aa, Unknown
  Description of Unknown: Linker sequence
YYPA

SEQ ID NO: 1965 - protein, 5 aa, Unknown
  Description of Unknown: Linker sequence
SGQPL

SEQ ID NO: 1966 - protein, 5 aa, Unknown
  Description of Unknown: Linker sequence
VYSGK

SEQ ID NO: 1967 - protein, 7 aa, Unknown
  Description of Unknown: Linker sequence
VNDQGKE

SEQ ID NO: 1968 - protein, 11 aa, Unknown
  Description of Unknown: Linker sequence
FGNKYWLMLNE

SEQ ID NO: 1969 - protein, 19 aa, Unknown
  Description of Unknown: Linker sequence
QSFAPVKGASAVPLVGRAS

SEQ ID NO: 1970 - protein, 4 aa, Unknown
  Description of Unknown: Linker sequence
PVSE

SEQ ID NO: 1971 - protein, 5 aa, Unknown
  Description of Unknown: Linker sequence
AGKLV

SEQ ID NO: 1972 - protein, 7 aa, Unknown
  Description of Unknown: Linker sequence
LEKDGSN

SEQ ID NO: 1973 - protein, 14 aa, Unknown
  Description of Unknown: Linker sequence
NNDPSWNPGPTWDP

SEQ ID NO: 1974 - protein, 4 aa, Unknown
  Description of Unknown: Linker sequence
GVPF

SEQ ID NO: 1975 - protein, 4 aa, Unknown
  Description of Unknown: Linker sequence
ICQS

SEQ ID NO: 1976 - protein, 6 aa, Unknown
  Description of Unknown: Linker sequence
VNYEDP

SEQ ID NO: 1977 - protein, 8 aa, Unknown
  Description of Unknown: Linker sequence
RARGENEP

SEQ ID NO: 1978 - protein, 6 aa, Unknown
  Description of Unknown: Linker sequence
LAGTGP

SEQ ID NO: 1979 - protein, 10 aa, Unknown
  Description of Unknown: Linker sequence
AAGGSVKGKK

SEQ ID NO: 1980 - protein, 8 aa, Unknown
  Description of Unknown: Linker sequence
LMTPEYVA

SEQ ID NO: 1981 - protein, 17 aa, Unknown
  Description of Unknown: Linker sequence
GFESVLEAVTALAFYVP

SEQ ID NO: 1982 - protein, 18 aa, Unknown
  Description of Unknown: Linker sequence
HKLGAVDVPDLVYSEAGP

SEQ ID NO: 1983 - protein, 35 aa, Unknown
  Description of Unknown: Linker sequence
QHPPKDSSGQRVAVSPTSQRLQLLEPFDKWDGKDL

SEQ ID NO: 1984 - protein, 41 aa, Unknown
  Description of Unknown: Linker sequence
TLKFNPETDFLTGKDGKKFKLEAPDADELPRAEFDPGQDTY

SEQ ID NO: 1985 - protein, 4 aa, Unknown
  Description of Unknown: Linker sequence
LVLE

SEQ ID NO: 1986 - protein, 4 aa, Unknown
  Description of Unknown: Linker sequence
SESG

SEQ ID NO: 1987 - protein, 5 aa, Unknown
  Description of Unknown: Linker sequence
EISGM

SEQ ID NO: 1988 - protein, 5 aa, Unknown
  Description of Unknown: Linker sequence
FAARS

SEQ ID NO: 1989 - protein, 7 aa, Unknown
  Description of Unknown: Linker sequence
QKSGKGL

SEQ ID NO: 1990 - protein, 11 aa, Unknown
  Description of Unknown: Linker sequence
GEVFPQKKVSA

SEQ ID NO: 1991 - protein, 13 aa, Unknown
  Description of Unknown: Linker sequence
KHPAVRKEPGPGL

SEQ ID NO: 1992 - protein, 14 aa, Unknown
  Description of Unknown: Linker sequence
YPHWEGEIIRFETE

SEQ ID NO: 1993 - protein, 9 aa, Unknown
  Description of Unknown: Linker sequence
EYPALGEVF

SEQ ID NO: 1994 - protein, 7 aa, Unknown
  Description of Unknown: Linker sequence
QDDDCTP

SEQ ID NO: 1995 - protein, 4 aa, Unknown
  Description of Unknown: Linker sequence
HNGK

SEQ ID NO: 1996 - protein, 5 aa, Unknown
  Description of Unknown: Linker sequence
SSVSR

SEQ ID NO: 1997 - protein, 6 aa, Unknown
  Description of Unknown: Linker sequence
AAHPVG

SEQ ID NO: 1998 - protein, 6 aa, Unknown
  Description of Unknown: Linker sequence
ARFDVT

SEQ ID NO: 1999 - protein, 6 aa, Unknown
  Description of Unknown: Linker sequence
EGRDMN

SEQ ID NO: 2000 - protein, 6 aa, Unknown
  Description of Unknown: Linker sequence
KFLRTE

SEQ ID NO: 2001 - protein, 8 aa, Unknown
  Description of Unknown: Linker sequence
LDLFYNTP

SEQ ID NO: 2002 - protein, 8 aa, Unknown
  Description of Unknown: Linker sequence
RTAEQQEA

SEQ ID NO: 2003 - protein, 11 aa, Unknown
  Description of Unknown: Linker sequence
YRAVPEGGQKE

SEQ ID NO: 2004 - protein, 8 aa, Unknown
  Description of Unknown: Linker sequence
HDPRRFGR

SEQ ID NO: 2005 - protein, 10 aa, Unknown
  Description of Unknown: Linker sequence
RRGDYREIPL

SEQ ID NO: 2006 - protein, 11 aa, Unknown
  Description of Unknown: Linker sequence
RHAVYGREGLP

SEQ ID NO: 2007 - protein, 23 aa, Unknown
  Description of Unknown: Linker sequence
ELGGSTLSDQSYRQPDGLPGGFQ

SEQ ID NO: 2008 - protein, 6 aa, Unknown
  Description of Unknown: Linker sequence
ESGKTS

SEQ ID NO: 2009 - protein, 7 aa, Unknown
  Description of Unknown: Linker sequence
FLDIHNI

SEQ ID NO: 2010 - protein, 7 aa, Unknown
  Description of Unknown: Linker sequence
VYPNIEE

SEQ ID NO: 2011 - protein, 9 aa, Unknown
  Description of Unknown: Linker sequence
RQGIPNESW

SEQ ID NO: 2012 - protein, 17 aa, Unknown
  Description of Unknown: Linker sequence
TKINERYELCDTYPALL

SEQ ID NO: 2013 - protein, 4 aa, Unknown
  Description of Unknown: Linker sequence
NGIV

SEQ ID NO: 2014 - protein, 5 aa, Unknown
  Description of Unknown: Linker sequence
SRRVP

SEQ ID NO: 2015 - protein, 17 aa, Unknown
  Description of Unknown: Linker sequence
LEKEKQFEKYSELKGTV

SEQ ID NO: 2016 - protein, 12 aa, Unknown
  Description of Unknown: Linker sequence
KDSPKGVGRPTK

SEQ ID NO: 2017 - protein, 4 aa, Unknown
  Description of Unknown: Linker sequence
ILIP

SEQ ID NO: 2018 - protein, 4 aa, Unknown
  Description of Unknown: Linker sequence
LAPA

SEQ ID NO: 2019 - protein, 5 aa, Unknown
  Description of Unknown: Linker sequence
CSGEY

SEQ ID NO: 2020 - protein, 5 aa, Unknown
  Description of Unknown: Linker sequence
STPHP

SEQ ID NO: 2021 - protein, 5 aa, Unknown
  Description of Unknown: Linker sequence
WGCDK

SEQ ID NO: 2022 - protein, 6 aa, Unknown
  Description of Unknown: Linker sequence
YFAMDE

SEQ ID NO: 2023 - protein, 9 aa, Unknown
  Description of Unknown: Linker sequence
RAETIDDIR

SEQ ID NO: 2024 - protein, 6 aa, Unknown
  Description of Unknown: Linker sequence
NDDIQG

SEQ ID NO: 2025 - protein, 7 aa, Unknown
  Description of Unknown: Linker sequence
YREKYCT

SEQ ID NO: 2026 - protein, 4 aa, Unknown
  Description of Unknown: Linker sequence
DADL

SEQ ID NO: 2027 - protein, 4 aa, Unknown
  Description of Unknown: Linker sequence
PNTA

SEQ ID NO: 2028 - protein, 5 aa, Unknown
  Description of Unknown: Linker sequence
VAVGV

SEQ ID NO: 2029 - protein, 6 aa, Unknown
  Description of Unknown: Linker sequence
VNIALA

SEQ ID NO: 2030 - protein, 17 aa, Unknown
  Description of Unknown: Linker sequence
KNLEEPVKPFPGVQGSS

SEQ ID NO: 2031 - protein, 26 aa, Unknown
  Description of Unknown: Linker sequence
LKGTLELHPNGLIKTDEYMRTSEPDV

SEQ ID NO: 2032 - protein, 6 aa, Unknown
  Description of Unknown: Linker sequence
YYPQIA

SEQ ID NO: 2033 - protein, 4 aa, Unknown
  Description of Unknown: Linker sequence
LGDA

SEQ ID NO: 2034 - protein, 7 aa, Unknown
  Description of Unknown: Linker sequence
FKHSGGL

SEQ ID NO: 2035 - protein, 20 aa, Unknown
  Description of Unknown: Linker sequence
FEAERKENCPACSQLPQNIQ

SEQ ID NO: 2036 - protein, 8 aa, Unknown
  Description of Unknown: Linker sequence
YGLDTINK

SEQ ID NO: 2037 - protein, 9 aa, Unknown
  Description of Unknown: Linker sequence
SMDNPDNEI

SEQ ID NO: 2038 - protein, 10 aa, Unknown
  Description of Unknown: Linker sequence
QQGRYPGVSN

SEQ ID NO: 2039 - protein, 8 aa, Unknown
  Description of Unknown: Linker sequence
TKLQNPDL

SEQ ID NO: 2040 - protein, 10 aa, Unknown
  Description of Unknown: Linker sequence
GGRGYGSESG

SEQ ID NO: 2041 - protein, 12 aa, Unknown
  Description of Unknown: Linker sequence
LQQHRPSPELTL

SEQ ID NO: 2042 - protein, 17 aa, Unknown
  Description of Unknown: Linker sequence
LGGKWQPGRGPCVLQEY

SEQ ID NO: 2043 - protein, 5 aa, Unknown
  Description of Unknown: Linker sequence
YQKLT

SEQ ID NO: 2044 - protein, 7 aa, Unknown
  Description of Unknown: Linker sequence
FISNQTI

SEQ ID NO: 2045 - protein, 7 aa, Unknown
  Description of Unknown: Linker sequence
SWEGNPI

SEQ ID NO: 2046 - protein, 8 aa, Unknown
  Description of Unknown: Linker sequence
FREVVSPQ

SEQ ID NO: 2047 - protein, 9 aa, Unknown
  Description of Unknown: Linker sequence
LADVPSSPY

SEQ ID NO: 2048 - protein, 4 aa, Unknown
  Description of Unknown: Linker sequence
FVSA

SEQ ID NO: 2049 - protein, 4 aa, Unknown
  Description of Unknown: Linker sequence
HKRS

SEQ ID NO: 2050 - protein, 5 aa, Unknown
  Description of Unknown: Linker sequence
KAAPD

SEQ ID NO: 2051 - protein, 19 aa, Unknown
  Description of Unknown: Linker sequence
PLDSPDETEDPEPNYAGEP

SEQ ID NO: 2052 - protein, 6 aa, Unknown
  Description of Unknown: Linker sequence
EVGNEE

SEQ ID NO: 2053 - protein, 13 aa, Unknown
  Description of Unknown: Linker sequence
ALPDEETGLELNE

SEQ ID NO: 2054 - protein, 4 aa, Unknown
  Description of Unknown: Linker sequence
QVDA

SEQ ID NO: 2055 - protein, 5 aa, Unknown
  Description of Unknown: Linker sequence
WRKDP

SEQ ID NO: 2056 - protein, 6 aa, Unknown
  Description of Unknown: Linker sequence
PSHGII

SEQ ID NO: 2057 - protein, 7 aa, Unknown
  Description of Unknown: Linker sequence
EGQGKAK

SEQ ID NO: 2058 - protein, 8 aa, Unknown
  Description of Unknown: Linker sequence
KINLAIKT

SEQ ID NO: 2059 - protein, 8 aa, Unknown
  Description of Unknown: Linker sequence
TEMYDTPT

SEQ ID NO: 2060 - protein, 6 aa, Unknown
  Description of Unknown: Linker sequence
AHELPM

SEQ ID NO: 2061 - protein, 12 aa, Unknown
  Description of Unknown: Linker sequence
EKPKGRDSKKVR

SEQ ID NO: 2062 - protein, 14 aa, Unknown
  Description of Unknown: Linker sequence
IEGTSPEIVVNPVR

SEQ ID NO: 2063 - protein, 7 aa, Unknown
  Description of Unknown: Linker sequence
QRTKVQI

SEQ ID NO: 2064 - protein, 26 aa, Unknown
  Description of Unknown: Linker sequence
VDMGFDTSKLGSYQRVAEPVVPPQEM

SEQ ID NO: 2065 - protein, 5 aa, Unknown
  Description of Unknown: Linker sequence
MNAHI

SEQ ID NO: 2066 - protein, 6 aa, Unknown
  Description of Unknown: Linker sequence
ADDYQA

SEQ ID NO: 2067 - protein, 6 aa, Unknown
  Description of Unknown: Linker sequence
YEGFTG

SEQ ID NO: 2068 - protein, 7 aa, Unknown
  Description of Unknown: Linker sequence
QVDDPLK

SEQ ID NO: 2069 - protein, 11 aa, Unknown
  Description of Unknown: Linker sequence
YKPKRFEYVTW

SEQ ID NO: 2070 - protein, 13 aa, Unknown
  Description of Unknown: Linker sequence
ILPLWHHDDTYLF

SEQ ID NO: 2071 - protein, 22 aa, Unknown
  Description of Unknown: Linker sequence
DMILPKKSVSKVKQTQLLTTEG

SEQ ID NO: 2072 - protein, 4 aa, Unknown
  Description of Unknown: Linker sequence
IDNP

SEQ ID NO: 2073 - protein, 4 aa, Unknown
  Description of Unknown: Linker sequence
GMDH

SEQ ID NO: 2074 - protein, 4 aa, Unknown
  Description of Unknown: Linker sequence
IGDC

SEQ ID NO: 2075 - protein, 5 aa, Unknown
  Description of Unknown: Linker sequence
EGVLH

SEQ ID NO: 2076 - protein, 5 aa, Unknown
  Description of Unknown: Linker sequence
NQKEL

SEQ ID NO: 2077 - protein, 5 aa, Unknown
  Description of Unknown: Linker sequence
QGNAL

SEQ ID NO: 2078 - protein, 5 aa, Unknown
  Description of Unknown: Linker sequence
QSGYQ

SEQ ID NO: 2079 - protein, 6 aa, Unknown
  Description of Unknown: Linker sequence
ARPDDE

SEQ ID NO: 2080 - protein, 6 aa, Unknown
  Description of Unknown: Linker sequence
MGVSAI

SEQ ID NO: 2081 - protein, 6 aa, Unknown
  Description of Unknown: Linker sequence
RNFQGY

SEQ ID NO: 2082 - protein, 7 aa, Unknown
  Description of Unknown: Linker sequence
TTQGDTD

SEQ ID NO: 2083 - protein, 5 aa, Unknown
  Description of Unknown: Linker sequence
IRDAN

SEQ ID NO: 2084 - protein, 7 aa, Unknown
  Description of Unknown: Linker sequence
YARPSSA

SEQ ID NO: 2085 - protein, 4 aa, Unknown
  Description of Unknown: Linker sequence
RGKF

SEQ ID NO: 2086 - protein, 4 aa, Unknown
  Description of Unknown: Linker sequence
THAV

SEQ ID NO: 2087 - protein, 5 aa, Unknown
  Description of Unknown: Linker sequence
ETPKI

SEQ ID NO: 2088 - protein, 5 aa, Unknown
  Description of Unknown: Linker sequence
SDTAN

SEQ ID NO: 2089 - protein, 7 aa, Unknown
  Description of Unknown: Linker sequence
TKQLAPT

SEQ ID NO: 2090 - protein, 10 aa, Unknown
  Description of Unknown: Linker sequence
AGDYKNLGGE

SEQ ID NO: 2091 - protein, 19 aa, Unknown
  Description of Unknown: Linker sequence
TYYTFNFSLEGAKMSLPGT

SEQ ID NO: 2092 - protein, 5 aa, Unknown
  Description of Unknown: Linker sequence
YNKSS

SEQ ID NO: 2093 - protein, 8 aa, Unknown
  Description of Unknown: Linker sequence
YGTPDYKY

SEQ ID NO: 2094 - protein, 11 aa, Unknown
  Description of Unknown: Linker sequence
PYGKAHTLGLK

SEQ ID NO: 2095 - protein, 6 aa, Unknown
  Description of Unknown: Linker sequence
DTEEKK

SEQ ID NO: 2096 - protein, 19 aa, Unknown
  Description of Unknown: Linker sequence
DIPNRRRKVSKHKHANFYP

SEQ ID NO: 2097 - protein, 6 aa, Unknown
  Description of Unknown: Linker sequence
PCSHVV

SEQ ID NO: 2098 - protein, 6 aa, Unknown
  Description of Unknown: Linker sequence
ANENGT

SEQ ID NO: 2099 - protein, 6 aa, Unknown
  Description of Unknown: Linker sequence
NRKNNI

SEQ ID NO: 2100 - protein, 8 aa, Unknown
  Description of Unknown: Linker sequence
LAPEDYTG

SEQ ID NO: 2101 - protein, 4 aa, Unknown
  Description of Unknown: Linker sequence
IGGK

SEQ ID NO: 2102 - protein, 4 aa, Unknown
  Description of Unknown: Linker sequence
VGDD

SEQ ID NO: 2103 - protein, 6 aa, Unknown
  Description of Unknown: Linker sequence
INTTKY

SEQ ID NO: 2104 - protein, 7 aa, Unknown
  Description of Unknown: Linker sequence
AATVTGY

SEQ ID NO: 2105 - protein, 7 aa, Unknown
  Description of Unknown: Linker sequence
GGADGKT

SEQ ID NO: 2106 - protein, 7 aa, Unknown
  Description of Unknown: Linker sequence
QNKDGSI

SEQ ID NO: 2107 - protein, 7 aa, Unknown
  Description of Unknown: Linker sequence
TDNNGKT

SEQ ID NO: 2108 - protein, 8 aa, Unknown
  Description of Unknown: Linker sequence
AAGVTGTA

SEQ ID NO: 2109 - protein, 9 aa, Unknown
  Description of Unknown: Linker sequence
QVGANDGET

SEQ ID NO: 2110 - protein, 11 aa, Unknown
  Description of Unknown: Linker sequence
TADDGTSKTAL

SEQ ID NO: 2111 - protein, 21 aa, Unknown
  Description of Unknown: Linker sequence
LKQINSQTLGLDTLNVQQKYK

SEQ ID NO: 2112 - protein, 23 aa, Unknown
  Description of Unknown: Linker sequence
AEGHNFKAQPDLAEAAATTTENP

SEQ ID NO: 2113 - protein, 4 aa, Unknown
  Description of Unknown: Linker sequence
AGAR

SEQ ID NO: 2114 - protein, 5 aa, Unknown
  Description of Unknown: Linker sequence
AEALL

SEQ ID NO: 2115 - protein, 6 aa, Unknown
  Description of Unknown: Linker sequence
AWPEEV

SEQ ID NO: 2116 - protein, 6 aa, Unknown
  Description of Unknown: Linker sequence
NRGVEA

SEQ ID NO: 2117 - protein, 8 aa, Unknown
  Description of Unknown: Linker sequence
EALPLPFA

SEQ ID NO: 2118 - protein, 8 aa, Unknown
  Description of Unknown: Linker sequence
RGVDPLGQ

SEQ ID NO: 2119 - protein, 9 aa, Unknown
  Description of Unknown: Linker sequence
LEVTPNRPD

SEQ ID NO: 2120 - protein, 9 aa, Unknown
  Description of Unknown: Linker sequence
VEDPEGAPH

SEQ ID NO: 2121 - protein, 10 aa, Unknown
  Description of Unknown: Linker sequence
AGSPKPPEAI

SEQ ID NO: 2122 - protein, 10 aa, Unknown
  Description of Unknown: Linker sequence
FGLRVAPSPL

SEQ ID NO: 2123 - protein, 13 aa, Unknown
  Description of Unknown: Linker sequence
TIPLALPAFFPAP

SEQ ID NO: 2124 - protein, 14 aa, Unknown
  Description of Unknown: Linker sequence
LGYALVEPEAALKA

SEQ ID NO: 2125 - protein, 19 aa, Unknown
  Description of Unknown: Linker sequence
LPLPDKPLAFQDPSRHPAA

SEQ ID NO: 2126 - protein, 5 aa, Unknown
  Description of Unknown: Linker sequence
GLQSA

SEQ ID NO: 2127 - protein, 6 aa, Unknown
  Description of Unknown: Linker sequence
HGELTR

SEQ ID NO: 2128 - protein, 7 aa, Unknown
  Description of Unknown: Linker sequence
LKDKQLN

SEQ ID NO: 2129 - protein, 5 aa, Unknown
  Description of Unknown: Linker sequence
FYPQY

SEQ ID NO: 2130 - protein, 7 aa, Unknown
  Description of Unknown: Linker sequence
DFHYDEK

SEQ ID NO: 2131 - protein, 10 aa, Unknown
  Description of Unknown: Linker sequence
DYLLDFSAVY

SEQ ID NO: 2132 - protein, 10 aa, Unknown
  Description of Unknown: Linker sequence
PLDVTNRPRT

SEQ ID NO: 2133 - protein, 17 aa, Unknown
  Description of Unknown: Linker sequence
NGEYSLKSAVKLPNVLS

SEQ ID NO: 2134 - protein, 6 aa, Unknown
  Description of Unknown: Linker sequence
DRRAGL

SEQ ID NO: 2135 - protein, 7 aa, Unknown
  Description of Unknown: Linker sequence
FLASMDE

SEQ ID NO: 2136 - protein, 8 aa, Unknown
  Description of Unknown: Linker sequence
IMRETINV

SEQ ID NO: 2137 - protein, 11 aa, Unknown
  Description of Unknown: Linker sequence
RFPNARTSYTM

SEQ ID NO: 2138 - protein, 6 aa, Unknown
  Description of Unknown: Linker sequence
SDPAKV

SEQ ID NO: 2139 - protein, 11 aa, Unknown
  Description of Unknown: Linker sequence
TSNGASCMPSM

SEQ ID NO: 2140 - protein, 12 aa, Unknown
  Description of Unknown: Linker sequence
AGSAPAEPTGDV

SEQ ID NO: 2141 - protein, 7 aa, Unknown
  Description of Unknown: Linker sequence
MRVKNDF

SEQ ID NO: 2142 - protein, 14 aa, Unknown
  Description of Unknown: Linker sequence
YEGKDVHIKEDERY

SEQ ID NO: 2143 - protein, 15 aa, Unknown
  Description of Unknown: Linker sequence
LGLKIIDLSAIQDEV

SEQ ID NO: 2144 - protein, 5 aa, Unknown
  Description of Unknown: Linker sequence
LEPSR

SEQ ID NO: 2145 - protein, 6 aa, Unknown
  Description of Unknown: Linker sequence
CSNVAA

SEQ ID NO: 2146 - protein, 8 aa, Unknown
  Description of Unknown: Linker sequence
QKVTINPV

SEQ ID NO: 2147 - protein, 11 aa, Unknown
  Description of Unknown: Linker sequence
ALPPGAAKQQL

SEQ ID NO: 2148 - protein, 11 aa, Unknown
  Description of Unknown: Linker sequence
ALRRGTAGSVT

SEQ ID NO: 2149 - protein, 16 aa, Unknown
  Description of Unknown: Linker sequence
ESFGATNTNARENTPF

SEQ ID NO: 2150 - protein, 4 aa, Unknown
  Description of Unknown: Linker sequence
DCDY

SEQ ID NO: 2151 - protein, 4 aa, Unknown
  Description of Unknown: Linker sequence
DWSD

SEQ ID NO: 2152 - protein, 4 aa, Unknown
  Description of Unknown: Linker sequence
FAGQ

SEQ ID NO: 2153 - protein, 4 aa, Unknown
  Description of Unknown: Linker sequence
HEGV

SEQ ID NO: 2154 - protein, 4 aa, Unknown
  Description of Unknown: Linker sequence
RDGE

SEQ ID NO: 2155 - protein, 4 aa, Unknown
  Description of Unknown: Linker sequence
SATR

SEQ ID NO: 2156 - protein, 4 aa, Unknown
  Description of Unknown: Linker sequence
SIPA

SEQ ID NO: 2157 - protein, 4 aa, Unknown
  Description of Unknown: Linker sequence
VYGQ

SEQ ID NO: 2158 - protein, 5 aa, Unknown
  Description of Unknown: Linker sequence
ACGAT

SEQ ID NO: 2159 - protein, 5 aa, Unknown
  Description of Unknown: Linker sequence
VYQAA

SEQ ID NO: 2160 - protein, 6 aa, Unknown
  Description of Unknown: Linker sequence
EAGVDR

SEQ ID NO: 2161 - protein, 6 aa, Unknown
  Description of Unknown: Linker sequence
SGGKTV

SEQ ID NO: 2162 - protein, 7 aa, Unknown
  Description of Unknown: Linker sequence
VPLSEKV

SEQ ID NO: 2163 - protein, 8 aa, Unknown
  Description of Unknown: Linker sequence
ANHPRGFA

SEQ ID NO: 2164 - protein, 9 aa, Unknown
  Description of Unknown: Linker sequence
HDLQGERPY

SEQ ID NO: 2165 - protein, 10 aa, Unknown
  Description of Unknown: Linker sequence
GCDGFHGISR

SEQ ID NO: 2166 - protein, 11 aa, Unknown
  Description of Unknown: Linker sequence
ADTPPVSHELI

SEQ ID NO: 2167 - protein, 4 aa, Unknown
  Description of Unknown: Linker sequence
GHRQ

SEQ ID NO: 2168 - protein, 4 aa, Unknown
  Description of Unknown: Linker sequence
LTGA

SEQ ID NO: 2169 - protein, 6 aa, Unknown
  Description of Unknown: Linker sequence
ALPSEL

SEQ ID NO: 2170 - protein, 6 aa, Unknown
  Description of Unknown: Linker sequence
RAGGSI

SEQ ID NO: 2171 - protein, 6 aa, Unknown
  Description of Unknown: Linker sequence
VSADNV

SEQ ID NO: 2172 - protein, 11 aa, Unknown
  Description of Unknown: Linker sequence
HTQTDTSSPDP

SEQ ID NO: 2173 - protein, 12 aa, Unknown
  Description of Unknown: Linker sequence
LKREKQDESCSL

SEQ ID NO: 2174 - protein, 13 aa, Unknown
  Description of Unknown: Linker sequence
FNPLKTGVCQLDN

SEQ ID NO: 2175 - protein, 4 aa, Unknown
  Description of Unknown: Linker sequence
ALGI

SEQ ID NO: 2176 - protein, 4 aa, Unknown
  Description of Unknown: Linker sequence
KDGV

SEQ ID NO: 2177 - protein, 4 aa, Unknown
  Description of Unknown: Linker sequence
NLRS

SEQ ID NO: 2178 - protein, 6 aa, Unknown
  Description of Unknown: Linker sequence
EIPKPS

SEQ ID NO: 2179 - protein, 7 aa, Unknown
  Description of Unknown: Linker sequence
EKMVEPQ

SEQ ID NO: 2180 - protein, 10 aa, Unknown
  Description of Unknown: Linker sequence
KSKVYTRTPT

SEQ ID NO: 2181 - protein, 6 aa, Unknown
  Description of Unknown: Linker sequence
ELVPKP

SEQ ID NO: 2182 - protein, 6 aa, Unknown
  Description of Unknown: Linker sequence
FGFPGG

SEQ ID NO: 2183 - protein, 6 aa, Unknown
  Description of Unknown: Linker sequence
LRNLDE

SEQ ID NO: 2184 - protein, 7 aa, Unknown
  Description of Unknown: Linker sequence
FSNKKSW

SEQ ID NO: 2185 - protein, 7 aa, Unknown
  Description of Unknown: Linker sequence
LFEKNDF

SEQ ID NO: 2186 - protein, 7 aa, Unknown
  Description of Unknown: Linker sequence
LYPNACS

SEQ ID NO: 2187 - protein, 7 aa, Unknown
  Description of Unknown: Linker sequence
RRAVYAN

SEQ ID NO: 2188 - protein, 7 aa, Unknown
  Description of Unknown: Linker sequence
RSHRMPV

SEQ ID NO: 2189 - protein, 8 aa, Unknown
  Description of Unknown: Linker sequence
EWNWPQPV

SEQ ID NO: 2190 - protein, 16 aa, Unknown
  Description of Unknown: Linker sequence
ITPAYPSMCATHNITE

SEQ ID NO: 2191 - protein, 16 aa, Unknown
  Description of Unknown: Linker sequence
RLDQPQVPLSLTLSDK

SEQ ID NO: 2192 - protein, 21 aa, Unknown
  Description of Unknown: Linker sequence
ILKPIEDGPLQVRVWNPKIYA

SEQ ID NO: 2193 - protein, 16 aa, Unknown
  Description of Unknown: Linker sequence
ISSSMTNSTAASRPPV

SEQ ID NO: 2194 - protein, 5 aa, Unknown
  Description of Unknown: Linker sequence
ELVTV

SEQ ID NO: 2195 - protein, 11 aa, Unknown
  Description of Unknown: Linker sequence
HDDLWQTLPDP

SEQ ID NO: 2196 - protein, 4 aa, Unknown
  Description of Unknown: Linker sequence
QGTN

SEQ ID NO: 2197 - protein, 16 aa, Unknown
  Description of Unknown: Linker sequence
NVYPELRVPDHQDIAF

SEQ ID NO: 2198 - protein, 6 aa, Unknown
  Description of Unknown: Linker sequence
QLSVNQ

SEQ ID NO: 2199 - protein, 8 aa, Unknown
  Description of Unknown: Linker sequence
DKAQFRNG

SEQ ID NO: 2200 - protein, 13 aa, Unknown
  Description of Unknown: Linker sequence
ENPYRPVTFDYLM

SEQ ID NO: 2201 - protein, 27 aa, Unknown
  Description of Unknown: Linker sequence
DYGNSPLHRFKKPGSKNFQNIFPPSAT

SEQ ID NO: 2202 - protein, 10 aa, Unknown
  Description of Unknown: Linker sequence
FKPLPAQESE

SEQ ID NO: 2203 - protein, 7 aa, Unknown
  Description of Unknown: Linker sequence
KAAGLEM

SEQ ID NO: 2204 - protein, 8 aa, Unknown
  Description of Unknown: Linker sequence
EIPPQAII

SEQ ID NO: 2205 - protein, 27 aa, Unknown
  Description of Unknown: Linker sequence
ESGEPSSLPRPATHWPFKTAFQHHYLV

SEQ ID NO: 2206 - protein, 8 aa, Unknown
  Description of Unknown: Linker sequence
EVHYARPI

SEQ ID NO: 2207 - protein, 25 aa, Unknown
  Description of Unknown: Linker sequence
WSRLKAKDWGSSSGSQGREDSVLSY

SEQ ID NO: 2208 - protein, 4 aa, Unknown
  Description of Unknown: Linker sequence
LGTA

SEQ ID NO: 2209 - protein, 5 aa, Unknown
  Description of Unknown: Linker sequence
LGRRF

SEQ ID NO: 2210 - protein, 6 aa, Unknown
  Description of Unknown: Linker sequence
ANTDNT

SEQ ID NO: 2211 - protein, 6 aa, Unknown
  Description of Unknown: Linker sequence
KRTIPA

SEQ ID NO: 2212 - protein, 7 aa, Unknown
  Description of Unknown: Linker sequence
AIDDSNI

SEQ ID NO: 2213 - protein, 7 aa, Unknown
  Description of Unknown: Linker sequence
PLTKTDV

SEQ ID NO: 2214 - protein, 8 aa, Unknown
  Description of Unknown: Linker sequence
NYLVSDGI

SEQ ID NO: 2215 - protein, 9 aa, Unknown
  Description of Unknown: Linker sequence
LLDDEGFNW

SEQ ID NO: 2216 - protein, 4 aa, Unknown
  Description of Unknown: Linker sequence
TKAE

SEQ ID NO: 2217 - protein, 4 aa, Unknown
  Description of Unknown: Linker sequence
TVAV

SEQ ID NO: 2218 - protein, 4 aa, Unknown
  Description of Unknown: Linker sequence
YRTM

SEQ ID NO: 2219 - protein, 5 aa, Unknown
  Description of Unknown: Linker sequence
ARTPL

SEQ ID NO: 2220 - protein, 5 aa, Unknown
  Description of Unknown: Linker sequence
DRPDL

SEQ ID NO: 2221 - protein, 5 aa, Unknown
  Description of Unknown: Linker sequence
TGTAK

SEQ ID NO: 2222 - protein, 5 aa, Unknown
  Description of Unknown: Linker sequence
VAMQK

SEQ ID NO: 2223 - protein, 5 aa, Unknown
  Description of Unknown: Linker sequence
YNMQV

SEQ ID NO: 2224 - protein, 6 aa, Unknown
  Description of Unknown: Linker sequence
FRMYEK

SEQ ID NO: 2225 - protein, 6 aa, Unknown
  Description of Unknown: Linker sequence
QAAKST

SEQ ID NO: 2226 - protein, 7 aa, Unknown
  Description of Unknown: Linker sequence
YMTGQPV

SEQ ID NO: 2227 - protein, 8 aa, Unknown
  Description of Unknown: Linker sequence
VVEDGQVV

SEQ ID NO: 2228 - protein, 10 aa, Unknown
  Description of Unknown: Linker sequence
KEGLEIQNES

SEQ ID NO: 2229 - protein, 11 aa, Unknown
  Description of Unknown: Linker sequence
AFGIDNLFDVK

SEQ ID NO: 2230 - protein, 11 aa, Unknown
  Description of Unknown: Linker sequence
TIPTNRPVVRD

SEQ ID NO: 2231 - protein, 15 aa, Unknown
  Description of Unknown: Linker sequence
VDSFTGRLMKGRRYS

SEQ ID NO: 2232 - protein, 24 aa, Unknown
  Description of Unknown: Linker sequence
VRTLKAEKDYTYDIKTKAVQLTEE

SEQ ID NO: 2233 - protein, 12 aa, Unknown
  Description of Unknown: Linker sequence
DLPPLEEGRYYY

SEQ ID NO: 2234 - protein, 18 aa, Unknown
  Description of Unknown: Linker sequence
HGTALEHRRVVSPYGHRF

SEQ ID NO: 2235 - protein, 7 aa, Unknown
  Description of Unknown: Linker sequence
AEANVEY

SEQ ID NO: 2236 - protein, 9 aa, Unknown
  Description of Unknown: Linker sequence
IPLVTGPGV

SEQ ID NO: 2237 - protein, 4 aa, Unknown
  Description of Unknown: Linker sequence
INDV

SEQ ID NO: 2238 - protein, 4 aa, Unknown
  Description of Unknown: Linker sequence
KARL

SEQ ID NO: 2239 - protein, 5 aa, Unknown
  Description of Unknown: Linker sequence
HPEHG

SEQ ID NO: 2240 - protein, 5 aa, Unknown
  Description of Unknown: Linker sequence
YIGKP

SEQ ID NO: 2241 - protein, 7 aa, Unknown
  Description of Unknown: Linker sequence
YGYRRLR

SEQ ID NO: 2242 - protein, 8 aa, Unknown
  Description of Unknown: Linker sequence
EYLKRPLI

SEQ ID NO: 2243 - protein, 8 aa, Unknown
  Description of Unknown: Linker sequence
FADLPRKY

SEQ ID NO: 2244 - protein, 8 aa, Unknown
  Description of Unknown: Linker sequence
SGLQDVAH

SEQ ID NO: 2245 - protein, 13 aa, Unknown
  Description of Unknown: Linker sequence
VGGGLSTNPMLAQ

SEQ ID NO: 2246 - protein, 15 aa, Unknown
  Description of Unknown: Linker sequence
DDVGLQTTEACGDCP

SEQ ID NO: 2247 - protein, 16 aa, Unknown
  Description of Unknown: Linker sequence
DGPAPEPVKHPIDHVG

SEQ ID NO: 2248 - protein, 16 aa, Unknown
  Description of Unknown: Linker sequence
GSPLAGESLDEVLDPT

SEQ ID NO: 2249 - protein, 4 aa, Unknown
  Description of Unknown: Linker sequence
EVRE

SEQ ID NO: 2250 - protein, 4 aa, Unknown
  Description of Unknown: Linker sequence
HGEV

SEQ ID NO: 2251 - protein, 4 aa, Unknown
  Description of Unknown: Linker sequence
KLPP

SEQ ID NO: 2252 - protein, 6 aa, Unknown
  Description of Unknown: Linker sequence
FGREGN

SEQ ID NO: 2253 - protein, 6 aa, Unknown
  Description of Unknown: Linker sequence
LGKGSS

SEQ ID NO: 2254 - protein, 6 aa, Unknown
  Description of Unknown: Linker sequence
PFPKDV

SEQ ID NO: 2255 - protein, 6 aa, Unknown
  Description of Unknown: Linker sequence
SEHFGE

SEQ ID NO: 2256 - protein, 6 aa, Unknown
  Description of Unknown: Linker sequence
YTGVRR

SEQ ID NO: 2257 - protein, 7 aa, Unknown
  Description of Unknown: Linker sequence
DTHTLDY

SEQ ID NO: 2258 - protein, 8 aa, Unknown
  Description of Unknown: Linker sequence
ESDYEVGG

SEQ ID NO: 2259 - protein, 11 aa, Unknown
  Description of Unknown: Linker sequence
GNLPLGAGLSS

SEQ ID NO: 2260 - protein, 13 aa, Unknown
  Description of Unknown: Linker sequence
FSLNDLRKENSWI

SEQ ID NO: 2261 - protein, 9 aa, Unknown
  Description of Unknown: Linker sequence
EHGLAPPDR

SEQ ID NO: 2262 - protein, 12 aa, Unknown
  Description of Unknown: Linker sequence
AYPQTPLLPRDP

SEQ ID NO: 2263 - protein, 5 aa, Unknown
  Description of Unknown: Linker sequence
QFATV

SEQ ID NO: 2264 - protein, 4 aa, Unknown
  Description of Unknown: Linker sequence
LLTA

SEQ ID NO: 2265 - protein, 6 aa, Unknown
  Description of Unknown: Linker sequence
ARHPLL

SEQ ID NO: 2266 - protein, 6 aa, Unknown
  Description of Unknown: Linker sequence
LGGLEV

SEQ ID NO: 2267 - protein, 6 aa, Unknown
  Description of Unknown: Linker sequence
WTEGWE

SEQ ID NO: 2268 - protein, 7 aa, Unknown
  Description of Unknown: Linker sequence
YDEGLTS

SEQ ID NO: 2269 - protein, 8 aa, Unknown
  Description of Unknown: Linker sequence
TLGLRSPV

SEQ ID NO: 2270 - protein, 14 aa, Unknown
  Description of Unknown: Linker sequence
HLDLSAPKLRLREE

SEQ ID NO: 2271 - protein, 21 aa, Unknown
  Description of Unknown: Linker sequence
YATEKEEPKPERTEVVAKLRR

SEQ ID NO: 2272 - protein, 6 aa, Unknown
  Description of Unknown: Linker sequence
ELGVSL

SEQ ID NO: 2273 - protein, 6 aa, Unknown
  Description of Unknown: Linker sequence
MSSKGT

SEQ ID NO: 2274 - protein, 7 aa, Unknown
  Description of Unknown: Linker sequence
LKLGRAF

SEQ ID NO: 2275 - protein, 8 aa, Unknown
  Description of Unknown: Linker sequence
GFNIEKFP

SEQ ID NO: 2276 - protein, 15 aa, Unknown
  Description of Unknown: Linker sequence
TAPLPGYNTEFASGI

SEQ ID NO: 2277 - protein, 22 aa, Unknown
  Description of Unknown: Linker sequence
CFRNEVGLPDSSKTEKVTSETV

SEQ ID NO: 2278 - protein, 4 aa, Unknown
  Description of Unknown: Linker sequence
KSRT

SEQ ID NO: 2279 - protein, 5 aa, Unknown
  Description of Unknown: Linker sequence
DRAGA

SEQ ID NO: 2280 - protein, 5 aa, Unknown
  Description of Unknown: Linker sequence
FYVSA

SEQ ID NO: 2281 - protein, 5 aa, Unknown
  Description of Unknown: Linker sequence
IATGG

SEQ ID NO: 2282 - protein, 5 aa, Unknown
  Description of Unknown: Linker sequence
IGGGT

SEQ ID NO: 2283 - protein, 5 aa, Unknown
  Description of Unknown: Linker sequence
LFRKI

SEQ ID NO: 2284 - protein, 5 aa, Unknown
  Description of Unknown: Linker sequence
PRSLS

SEQ ID NO: 2285 - protein, 5 aa, Unknown
  Description of Unknown: Linker sequence
TGKKV

SEQ ID NO: 2286 - protein, 6 aa, Unknown
  Description of Unknown: Linker sequence
DVRGNM

SEQ ID NO: 2287 - protein, 6 aa, Unknown
  Description of Unknown: Linker sequence
LNDGSQ

SEQ ID NO: 2288 - protein, 6 aa, Unknown
  Description of Unknown: Linker sequence
NIENGG

SEQ ID NO: 2289 - protein, 6 aa, Unknown
  Description of Unknown: Linker sequence
RDPGAR

SEQ ID NO: 2290 - protein, 6 aa, Unknown
  Description of Unknown: Linker sequence
SREVKS

SEQ ID NO: 2291 - protein, 7 aa, Unknown
  Description of Unknown: Linker sequence
RQWNGKE

SEQ ID NO: 2292 - protein, 7 aa, Unknown
  Description of Unknown: Linker sequence
SIYFQPP

SEQ ID NO: 2293 - protein, 8 aa, Unknown
  Description of Unknown: Linker sequence
VPQIRAPS

SEQ ID NO: 2294 - protein, 8 aa, Unknown
  Description of Unknown: Linker sequence
WFSDDPNV

SEQ ID NO: 2295 - protein, 11 aa, Unknown
  Description of Unknown: Linker sequence
SEDPELPYMRP

SEQ ID NO: 2296 - protein, 8 aa, Unknown
  Description of Unknown: Linker sequence
AFDGPFDE

SEQ ID NO: 2297 - protein, 6 aa, Unknown
  Description of Unknown: Linker sequence
HGDDRG

SEQ ID NO: 2298 - protein, 5 aa, Unknown
  Description of Unknown: Linker sequence
LRPSP

SEQ ID NO: 2299 - protein, 4 aa, Unknown
  Description of Unknown: Linker sequence
LNVA

SEQ ID NO: 2300 - protein, 6 aa, Unknown
  Description of Unknown: Linker sequence
LSTSQK

SEQ ID NO: 2301 - protein, 21 aa, Unknown
  Description of Unknown: Linker sequence
GAADIGLGYPNGNQGWGRVTL

SEQ ID NO: 2302 - protein, 4 aa, Unknown
  Description of Unknown: Linker sequence
YIGI

SEQ ID NO: 2303 - protein, 7 aa, Unknown
  Description of Unknown: Linker sequence
DGRVIRG

SEQ ID NO: 2304 - protein, 17 aa, Unknown
  Description of Unknown: Linker sequence
TLSFDKSNDGETPEGIG

SEQ ID NO: 2305 - protein, 18 aa, Unknown
  Description of Unknown: Linker sequence
EIAPLHAQGGGIDQLQGI

SEQ ID NO: 2306 - protein, 4 aa, Unknown
  Description of Unknown: Linker sequence
ANNG

SEQ ID NO: 2307 - protein, 4 aa, Unknown
  Description of Unknown: Linker sequence
ESNL

SEQ ID NO: 2308 - protein, 4 aa, Unknown
  Description of Unknown: Linker sequence
KISA

SEQ ID NO: 2309 - protein, 4 aa, Unknown
  Description of Unknown: Linker sequence
MDSA

SEQ ID NO: 2310 - protein, 4 aa, Unknown
  Description of Unknown: Linker sequence
MMTP

SEQ ID NO: 2311 - protein, 4 aa, Unknown
  Description of Unknown: Linker sequence
VGGI

SEQ ID NO: 2312 - protein, 5 aa, Unknown
  Description of Unknown: Linker sequence
YTQRL

SEQ ID NO: 2313 - protein, 6 aa, Unknown
  Description of Unknown: Linker sequence
AEKGKA

SEQ ID NO: 2314 - protein, 6 aa, Unknown
  Description of Unknown: Linker sequence
MIRVPV

SEQ ID NO: 2315 - protein, 7 aa, Unknown
  Description of Unknown: Linker sequence
SYTATED

SEQ ID NO: 2316 - protein, 8 aa, Unknown
  Description of Unknown: Linker sequence
ETINPAHP

SEQ ID NO: 2317 - protein, 8 aa, Unknown
  Description of Unknown: Linker sequence
SKFSGGNL

SEQ ID NO: 2318 - protein, 8 aa, Unknown
  Description of Unknown: Linker sequence
TAYFVDAP

SEQ ID NO: 2319 - protein, 9 aa, Unknown
  Description of Unknown: Linker sequence
ISPKEPHNK

SEQ ID NO: 2320 - protein, 9 aa, Unknown
  Description of Unknown: Linker sequence
LSDKPGNPV

SEQ ID NO: 2321 - protein, 9 aa, Unknown
  Description of Unknown: Linker sequence
RYPSITRDM

SEQ ID NO: 2322 - protein, 10 aa, Unknown
  Description of Unknown: Linker sequence
MLSQVPYFSR

SEQ ID NO: 2323 - protein, 11 aa, Unknown
  Description of Unknown: Linker sequence
APSRYFASEPK

SEQ ID NO: 2324 - protein, 14 aa, Unknown
  Description of Unknown: Linker sequence
HTLDAVNIADRYDA

SEQ ID NO: 2325 - protein, 31 aa, Unknown
  Description of Unknown: Linker sequence
ADIALSLPELNPYIPDDFSLIKSEKKYDHPE

SEQ ID NO: 2326 - protein, 7 aa, Unknown
  Description of Unknown: Linker sequence
DVQPMQY

SEQ ID NO: 2327 - protein, 11 aa, Unknown
  Description of Unknown: Linker sequence
HMSPSWTLLKL

SEQ ID NO: 2328 - protein, 8 aa, Unknown
  Description of Unknown: Linker sequence
LEMVSKPM

SEQ ID NO: 2329 - protein, 51 aa, Unknown
  Description of Unknown: Linker sequence
YGPKGKGKGMGAGTLSTDKGESLGIKYEEGQSHRPTNPNASRMAQKVGGSD

SEQ ID NO: 2330 - protein, 5 aa, Unknown
  Description of Unknown: Linker sequence
VGQSL

SEQ ID NO: 2331 - protein, 6 aa, Unknown
  Description of Unknown: Linker sequence
VSRSST

SEQ ID NO: 2332 - protein, 12 aa, Unknown
  Description of Unknown: Linker sequence
ERNDVAPNKPDE

SEQ ID NO: 2333 - protein, 12 aa, Unknown
  Description of Unknown: Linker sequence
TETAAAADPGLS

SEQ ID NO: 2334 - protein, 14 aa, Unknown
  Description of Unknown: Linker sequence
VAESDRPELTSARR

SEQ ID NO: 2335 - protein, 4 aa, Unknown
  Description of Unknown: Linker sequence
PFYP

SEQ ID NO: 2336 - protein, 6 aa, Unknown
  Description of Unknown: Linker sequence
GVSEKP

SEQ ID NO: 2337 - protein, 9 aa, Unknown
  Description of Unknown: Linker sequence
LGMGDVASL

SEQ ID NO: 2338 - protein, 15 aa, Unknown
  Description of Unknown: Linker sequence
ALGGEARLPVLKDRN

SEQ ID NO: 2339 - protein, 17 aa, Unknown
  Description of Unknown: Linker sequence
AAGLEAEAPKSAKELSL

SEQ ID NO: 2340 - protein, 4 aa, Unknown
  Description of Unknown: Linker sequence
KGRF

SEQ ID NO: 2341 - protein, 5 aa, Unknown
  Description of Unknown: Linker sequence
KAGSL

SEQ ID NO: 2342 - protein, 6 aa, Unknown
  Description of Unknown: Linker sequence
NTGIFI

SEQ ID NO: 2343 - protein, 6 aa, Unknown
  Description of Unknown: Linker sequence
QLVKSE

SEQ ID NO: 2344 - protein, 7 aa, Unknown
  Description of Unknown: Linker sequence
KLKYVPH

SEQ ID NO: 2345 - protein, 7 aa, Unknown
  Description of Unknown: Linker sequence
LGFDEVI

SEQ ID NO: 2346 - protein, 9 aa, Unknown
  Description of Unknown: Linker sequence
MLATNLTDK

SEQ ID NO: 2347 - protein, 16 aa, Unknown
  Description of Unknown: Linker sequence
LKDHILQFVIPNRGVT

SEQ ID NO: 2348 - protein, 17 aa, Unknown
  Description of Unknown: Linker sequence
RAKGSTKFTRVPKRVYW

SEQ ID NO: 2349 - protein, 5 aa, Unknown
  Description of Unknown: Linker sequence
FQKLM

SEQ ID NO: 2350 - protein, 6 aa, Unknown
  Description of Unknown: Linker sequence
NAPTPQ

SEQ ID NO: 2351 - protein, 8 aa, Unknown
  Description of Unknown: Linker sequence
EFKEGEDA

SEQ ID NO: 2352 - protein, 6 aa, Unknown
  Description of Unknown: Linker sequence
AGTLLP

SEQ ID NO: 2353 - protein, 6 aa, Unknown
  Description of Unknown: Linker sequence
LAPYKV

SEQ ID NO: 2354 - protein, 7 aa, Unknown
  Description of Unknown: Linker sequence
ESIKDDK

SEQ ID NO: 2355 - protein, 7 aa, Unknown
  Description of Unknown: Linker sequence
FHDKPEI

SEQ ID NO: 2356 - protein, 8 aa, Unknown
  Description of Unknown: Linker sequence
ITTPKDDE

SEQ ID NO: 2357 - protein, 9 aa, Unknown
  Description of Unknown: Linker sequence
HDITPSMTP

SEQ ID NO: 2358 - protein, 10 aa, Unknown
  Description of Unknown: Linker sequence
AEATVAPVSP

SEQ ID NO: 2359 - protein, 11 aa, Unknown
  Description of Unknown: Linker sequence
IDALADKYEPS

SEQ ID NO: 2360 - protein, 4 aa, Unknown
  Description of Unknown: Linker sequence
FYGK

SEQ ID NO: 2361 - protein, 8 aa, Unknown
  Description of Unknown: Linker sequence
ALSNTGEI

SEQ ID NO: 2362 - protein, 15 aa, Unknown
  Description of Unknown: Linker sequence
TATPPGSVTVPHPNI

SEQ ID NO: 2363 - protein, 19 aa, Unknown
  Description of Unknown: Linker sequence
RSPVFTDNSSPPAVPQSFQ

SEQ ID NO: 2364 - protein, 8 aa, Unknown
  Description of Unknown: Linker sequence
IRNIDQDV

SEQ ID NO: 2365 - protein, 8 aa, Unknown
  Description of Unknown: Linker sequence
REETNLMD

SEQ ID NO: 2366 - protein, 6 aa, Unknown
  Description of Unknown: Linker sequence
HALPLV

SEQ ID NO: 2367 - protein, 6 aa, Unknown
  Description of Unknown: Linker sequence
EGRSKK

SEQ ID NO: 2368 - protein, 27 aa, Unknown
  Description of Unknown: Linker sequence
NKEKKAVSPLLLTTTNSSEGLSMGNYI

SEQ ID NO: 2369 - protein, 7 aa, Unknown
  Description of Unknown: Linker sequence
DLASGQI

SEQ ID NO: 2370 - protein, 7 aa, Unknown
  Description of Unknown: Linker sequence
TLANGAV

SEQ ID NO: 2371 - protein, 8 aa, Unknown
  Description of Unknown: Linker sequence
DYDGYNQF

SEQ ID NO: 2372 - protein, 9 aa, Unknown
  Description of Unknown: Linker sequence
DTGGAPGTV

SEQ ID NO: 2373 - protein, 9 aa, Unknown
  Description of Unknown: Linker sequence
QTNGGQFPY

SEQ ID NO: 2374 - protein, 10 aa, Unknown
  Description of Unknown: Linker sequence
TGIKGAFRTR

SEQ ID NO: 2375 - protein, 5 aa, Unknown
  Description of Unknown: Linker sequence
SLPAR

SEQ ID NO: 2376 - protein, 4 aa, Unknown
  Description of Unknown: Linker sequence
IYPD

SEQ ID NO: 2377 - protein, 4 aa, Unknown
  Description of Unknown: Linker sequence
KCAV

SEQ ID NO: 2378 - protein, 4 aa, Unknown
  Description of Unknown: Linker sequence
MAPK

SEQ ID NO: 2379 - protein, 4 aa, Unknown
  Description of Unknown: Linker sequence
TESL

SEQ ID NO: 2380 - protein, 5 aa, Unknown
  Description of Unknown: Linker sequence
ASADQ

SEQ ID NO: 2381 - protein, 10 aa, Unknown
  Description of Unknown: Linker sequence
YTLRQPPPAT

SEQ ID NO: 2382 - protein, 11 aa, Unknown
  Description of Unknown: Linker sequence
DQSDPNDPKSR

SEQ ID NO: 2383 - protein, 24 aa, Unknown
  Description of Unknown: Linker sequence
SLHDMADEAGLPVQTEDGEATGTI

SEQ ID NO: 2384 - protein, 5 aa, Unknown
  Description of Unknown: Linker sequence
DGIEE

SEQ ID NO: 2385 - protein, 6 aa, Unknown
  Description of Unknown: Linker sequence
VEHLPK

SEQ ID NO: 2386 - protein, 4 aa, Unknown
  Description of Unknown: Linker sequence
QAHS

SEQ ID NO: 2387 - protein, 7 aa, Unknown
  Description of Unknown: Linker sequence
AKEAFVS

SEQ ID NO: 2388 - protein, 9 aa, Unknown
  Description of Unknown: Linker sequence
QGILLHRSR

SEQ ID NO: 2389 - protein, 4 aa, Unknown
  Description of Unknown: Linker sequence
ESEY

SEQ ID NO: 2390 - protein, 5 aa, Unknown
  Description of Unknown: Linker sequence
DGPTP

SEQ ID NO: 2391 - protein, 8 aa, Unknown
  Description of Unknown: Linker sequence
VGSEKVSK

SEQ ID NO: 2392 - protein, 4 aa, Unknown
  Description of Unknown: Linker sequence
IGQS

SEQ ID NO: 2393 - protein, 15 aa, Unknown
  Description of Unknown: Linker sequence
VSNINNTVSPSSASF

SEQ ID NO: 2394 - protein, 16 aa, Unknown
  Description of Unknown: Linker sequence
ALPTNARPLLPPISNP

SEQ ID NO: 2395 - protein, 8 aa, Unknown
  Description of Unknown: Linker sequence
VRERPVPR

SEQ ID NO: 2396 - protein, 9 aa, Unknown
  Description of Unknown: Linker sequence
EQADGAVRG

SEQ ID NO: 2397 - protein, 13 aa, Unknown
  Description of Unknown: Linker sequence
ARSGYRPDSGATP

SEQ ID NO: 2398 - protein, 8 aa, Unknown
  Description of Unknown: Linker sequence
PDIDKLGY

SEQ ID NO: 2399 - protein, 5 aa, Unknown
  Description of Unknown: Linker sequence
LGYSM

SEQ ID NO: 2400 - protein, 13 aa, Unknown
  Description of Unknown: Linker sequence
SGVIKKFTAIIDP

SEQ ID NO: 2401 - protein, 6 aa, Unknown
  Description of Unknown: Linker sequence
RTSRQL

SEQ ID NO: 2402 - protein, 4 aa, Unknown
  Description of Unknown: Linker sequence
SGCK

SEQ ID NO: 2403 - protein, 5 aa, Unknown
  Description of Unknown: Linker sequence
VSTGV

SEQ ID NO: 2404 - protein, 10 aa, Unknown
  Description of Unknown: Linker sequence
QALDGDITDM

SEQ ID NO: 2405 - protein, 8 aa, Unknown
  Description of Unknown: Linker sequence
HTAGSIPM

SEQ ID NO: 2406 - protein, 8 aa, Unknown
  Description of Unknown: Linker sequence
WEGHVPHY

SEQ ID NO: 2407 - protein, 9 aa, Unknown
  Description of Unknown: Linker sequence
VEGKREEAL

SEQ ID NO: 2408 - protein, 13 aa, Unknown
  Description of Unknown: Linker sequence
PMQTFSKQREVDF

SEQ ID NO: 2409 - protein, 10 aa, Unknown
  Description of Unknown: Linker sequence
VYFNERINVD

SEQ ID NO: 2410 - protein, 6 aa, Unknown
  Description of Unknown: Linker sequence
SGGPAT

SEQ ID NO: 2411 - protein, 8 aa, Unknown
  Description of Unknown: Linker sequence
YAATSTGR

SEQ ID NO: 2412 - protein, 9 aa, Unknown
  Description of Unknown: Linker sequence
TGGTEAAGG

SEQ ID NO: 2413 - protein, 6 aa, Unknown
  Description of Unknown: Linker sequence
FDPTEF

SEQ ID NO: 2414 - protein, 7 aa, Unknown
  Description of Unknown: Linker sequence
VDLDFNR

SEQ ID NO: 2415 - protein, 10 aa, Unknown
  Description of Unknown: Linker sequence
SNDAGFAMTS

SEQ ID NO: 2416 - protein, 11 aa, Unknown
  Description of Unknown: Linker sequence
NGFDPATGDLS

SEQ ID NO: 2417 - protein, 8 aa, Unknown
  Description of Unknown: Linker sequence
FSQPAPDR

SEQ ID NO: 2418 - protein, 5 aa, Unknown
  Description of Unknown: Linker sequence
CQPNE

SEQ ID NO: 2419 - protein, 5 aa, Unknown
  Description of Unknown: Linker sequence
KGVPC

SEQ ID NO: 2420 - protein, 5 aa, Unknown
  Description of Unknown: Linker sequence
PFITE

SEQ ID NO: 2421 - protein, 6 aa, Unknown
  Description of Unknown: Linker sequence
SIPTCE

SEQ ID NO: 2422 - protein, 6 aa, Unknown
  Description of Unknown: Linker sequence
VEEHNI

SEQ ID NO: 2423 - protein, 7 aa, Unknown
  Description of Unknown: Linker sequence
SNKEVIQ

SEQ ID NO: 2424 - protein, 7 aa, Unknown
  Description of Unknown: Linker sequence
TAKGDTK

SEQ ID NO: 2425 - protein, 9 aa, Unknown
  Description of Unknown: Linker sequence
GRWYPAFAD

SEQ ID NO: 2426 - protein, 16 aa, Unknown
  Description of Unknown: Linker sequence
IFYDFLHVNVIPTVSF

SEQ ID NO: 2427 - protein, 5 aa, Unknown
  Description of Unknown: Linker sequence
PGPAS

SEQ ID NO: 2428 - protein, 7 aa, Unknown
  Description of Unknown: Linker sequence
KVSKKTG

SEQ ID NO: 2429 - protein, 8 aa, Unknown
  Description of Unknown: Linker sequence
ACNIASMP

SEQ ID NO: 2430 - protein, 8 aa, Unknown
  Description of Unknown: Linker sequence
FNDEASDE

SEQ ID NO: 2431 - protein, 18 aa, Unknown
  Description of Unknown: Linker sequence
SLNAGELKKAAPADPSAP

SEQ ID NO: 2432 - protein, 10 aa, Unknown
  Description of Unknown: Linker sequence
DKYYMASPDL

SEQ ID NO: 2433 - protein, 10 aa, Unknown
  Description of Unknown: Linker sequence
NATNATQPIH

SEQ ID NO: 2434 - protein, 4 aa, Unknown
  Description of Unknown: Linker sequence
EFPP

SEQ ID NO: 2435 - protein, 9 aa, Unknown
  Description of Unknown: Linker sequence
ENELMYGVP

SEQ ID NO: 2436 - protein, 13 aa, Unknown
  Description of Unknown: Linker sequence
QSKDFLIPIGKAK

SEQ ID NO: 2437 - protein, 4 aa, Unknown
  Description of Unknown: Linker sequence
AGEV

SEQ ID NO: 2438 - protein, 4 aa, Unknown
  Description of Unknown: Linker sequence
LHPT

SEQ ID NO: 2439 - protein, 4 aa, Unknown
  Description of Unknown: Linker sequence
RIEA

SEQ ID NO: 2440 - protein, 4 aa, Unknown
  Description of Unknown: Linker sequence
SPGA

SEQ ID NO: 2441 - protein, 4 aa, Unknown
  Description of Unknown: Linker sequence
YFTA

SEQ ID NO: 2442 - protein, 6 aa, Unknown
  Description of Unknown: Linker sequence
DGSTGK

SEQ ID NO: 2443 - protein, 6 aa, Unknown
  Description of Unknown: Linker sequence
EKGERV

SEQ ID NO: 2444 - protein, 6 aa, Unknown
  Description of Unknown: Linker sequence
KGDIET

SEQ ID NO: 2445 - protein, 7 aa, Unknown
  Description of Unknown: Linker sequence
DEGMITE

SEQ ID NO: 2446 - protein, 7 aa, Unknown
  Description of Unknown: Linker sequence
QEASVSG

SEQ ID NO: 2447 - protein, 4 aa, Unknown
  Description of Unknown: Linker sequence
EAAN

SEQ ID NO: 2448 - protein, 4 aa, Unknown
  Description of Unknown: Linker sequence
RYGL

SEQ ID NO: 2449 - protein, 5 aa, Unknown
  Description of Unknown: Linker sequence
EVLDY

SEQ ID NO: 2450 - protein, 5 aa, Unknown
  Description of Unknown: Linker sequence
RPFVS

SEQ ID NO: 2451 - protein, 5 aa, Unknown
  Description of Unknown: Linker sequence
SLVNQ

SEQ ID NO: 2452 - protein, 5 aa, Unknown
  Description of Unknown: Linker sequence
SMGSS

SEQ ID NO: 2453 - protein, 6 aa, Unknown
  Description of Unknown: Linker sequence
SKEFSP

SEQ ID NO: 2454 - protein, 7 aa, Unknown
  Description of Unknown: Linker sequence
AAKGEKI

SEQ ID NO: 2455 - protein, 7 aa, Unknown
  Description of Unknown: Linker sequence
GAPDAER

SEQ ID NO: 2456 - protein, 7 aa, Unknown
  Description of Unknown: Linker sequence
RGEAMPK

SEQ ID NO: 2457 - protein, 8 aa, Unknown
  Description of Unknown: Linker sequence
SGAKKNHF

SEQ ID NO: 2458 - protein, 8 aa, Unknown
  Description of Unknown: Linker sequence
TGRSYKLF

SEQ ID NO: 2459 - protein, 9 aa, Unknown
  Description of Unknown: Linker sequence
AALPASAKV

SEQ ID NO: 2460 - protein, 9 aa, Unknown
  Description of Unknown: Linker sequence
DGFRTSHEI

SEQ ID NO: 2461 - protein, 10 aa, Unknown
  Description of Unknown: Linker sequence
KSMNPEHPHV

SEQ ID NO: 2462 - protein, 10 aa, Unknown
  Description of Unknown: Linker sequence
RGTAQNPDIY

SEQ ID NO: 2463 - protein, 11 aa, Unknown
  Description of Unknown: Linker sequence
WVPENCIQCNQ

SEQ ID NO: 2464 - protein, 12 aa, Unknown
  Description of Unknown: Linker sequence
DRTKEPGAPGDP

SEQ ID NO: 2465 - protein, 28 aa, Unknown
  Description of Unknown: Linker sequence
TVGIEDDVTGTSLPVDNAFADTTPKGTI

SEQ ID NO: 2466 - protein, 4 aa, Unknown
  Description of Unknown: Linker sequence
AGED

SEQ ID NO: 2467 - protein, 4 aa, Unknown
  Description of Unknown: Linker sequence
DADS

SEQ ID NO: 2468 - protein, 4 aa, Unknown
  Description of Unknown: Linker sequence
DGTV

SEQ ID NO: 2469 - protein, 4 aa, Unknown
  Description of Unknown: Linker sequence
QDGR

SEQ ID NO: 2470 - protein, 5 aa, Unknown
  Description of Unknown: Linker sequence
LGAGE

SEQ ID NO: 2471 - protein, 5 aa, Unknown
  Description of Unknown: Linker sequence
QPGRG

SEQ ID NO: 2472 - protein, 6 aa, Unknown
  Description of Unknown: Linker sequence
DFADGS

SEQ ID NO: 2473 - protein, 6 aa, Unknown
  Description of Unknown: Linker sequence
YDRPDR

SEQ ID NO: 2474 - protein, 7 aa, Unknown
  Description of Unknown: Linker sequence
KADAAPQ

SEQ ID NO: 2475 - protein, 15 aa, Unknown
  Description of Unknown: Linker sequence
PLGEAPDAYADDASG

SEQ ID NO: 2476 - protein, 4 aa, Unknown
  Description of Unknown: Linker sequence
PCFP

SEQ ID NO: 2477 - protein, 7 aa, Unknown
  Description of Unknown: Linker sequence
DLESPVK

SEQ ID NO: 2478 - protein, 7 aa, Unknown
  Description of Unknown: Linker sequence
FLRIQNV

SEQ ID NO: 2479 - protein, 10 aa, Unknown
  Description of Unknown: Linker sequence
LGHPCTRTPH

SEQ ID NO: 2480 - protein, 6 aa, Unknown
  Description of Unknown: Linker sequence
HFPKTF

SEQ ID NO: 2481 - protein, 7 aa, Unknown
  Description of Unknown: Linker sequence
RKLLGVK

SEQ ID NO: 2482 - protein, 7 aa, Unknown
  Description of Unknown: Linker sequence
SATPIPR

SEQ ID NO: 2483 - protein, 8 aa, Unknown
  Description of Unknown: Linker sequence
FYGDLDVT

SEQ ID NO: 2484 - protein, 8 aa, Unknown
  Description of Unknown: Linker sequence
SLPFKLTN

SEQ ID NO: 2485 - protein, 9 aa, Unknown
  Description of Unknown: Linker sequence
CSLKETLPE

SEQ ID NO: 2486 - protein, 9 aa, Unknown
  Description of Unknown: Linker sequence
ISEKPMNRL

SEQ ID NO: 2487 - protein, 9 aa, Unknown
  Description of Unknown: Linker sequence
TMLVPMDRV

SEQ ID NO: 2488 - protein, 10 aa, Unknown
  Description of Unknown: Linker sequence
IYRLTSGISQ

SEQ ID NO: 2489 - protein, 11 aa, Unknown
  Description of Unknown: Linker sequence
HGGIPKKIEGK

SEQ ID NO: 2490 - protein, 12 aa, Unknown
  Description of Unknown: Linker sequence
IDEMPPGRKEVQ

SEQ ID NO: 2491 - protein, 12 aa, Unknown
  Description of Unknown: Linker sequence
TPKEGEYVRRIL

SEQ ID NO: 2492 - protein, 9 aa, Unknown
  Description of Unknown: Linker sequence
KSDYTQNNI

SEQ ID NO: 2493 - protein, 15 aa, Unknown
  Description of Unknown: Linker sequence
EGMGPVLAPVTPVPV

SEQ ID NO: 2494 - protein, 7 aa, Unknown
  Description of Unknown: Linker sequence
MLNQNWH

SEQ ID NO: 2495 - protein, 10 aa, Unknown
  Description of Unknown: Linker sequence
NMTNATDASP

SEQ ID NO: 2496 - protein, 14 aa, Unknown
  Description of Unknown: Linker sequence
LLYDERTTNLTLDE

SEQ ID NO: 2497 - protein, 6 aa, Unknown
  Description of Unknown: Linker sequence
EAGYPG

SEQ ID NO: 2498 - protein, 7 aa, Unknown
  Description of Unknown: Linker sequence
LFDSLSP

SEQ ID NO: 2499 - protein, 7 aa, Unknown
  Description of Unknown: Linker sequence
TREGKST

SEQ ID NO: 2500 - protein, 5 aa, Unknown
  Description of Unknown: Linker sequence
AEGDM

SEQ ID NO: 2501 - protein, 6 aa, Unknown
  Description of Unknown: Linker sequence
AALDKK

SEQ ID NO: 2502 - protein, 6 aa, Unknown
  Description of Unknown: Linker sequence
ENEGLE

SEQ ID NO: 2503 - protein, 7 aa, Unknown
  Description of Unknown: Linker sequence
RFRPLRD

SEQ ID NO: 2504 - protein, 7 aa, Unknown
  Description of Unknown: Linker sequence
VASRARP

SEQ ID NO: 2505 - protein, 4 aa, Unknown
  Description of Unknown: Linker sequence
TKNI

SEQ ID NO: 2506 - protein, 6 aa, Unknown
  Description of Unknown: Linker sequence
VSAGST

SEQ ID NO: 2507 - protein, 9 aa, Unknown
  Description of Unknown: Linker sequence
SGSVKTGTT

SEQ ID NO: 2508 - protein, 10 aa, Unknown
  Description of Unknown: Linker sequence
DLDIKGYVAA

SEQ ID NO: 2509 - protein, 13 aa, Unknown
  Description of Unknown: Linker sequence
SRSGTPSTSIDTS

SEQ ID NO: 2510 - protein, 9 aa, Unknown
  Description of Unknown: Linker sequence
CDGDEYKPV

SEQ ID NO: 2511 - protein, 14 aa, Unknown
  Description of Unknown: Linker sequence
DGPCEPDEDEDVCQ

SEQ ID NO: 2512 - protein, 14 aa, Unknown
  Description of Unknown: Linker sequence
RAVLSSTRMGGHFV

SEQ ID NO: 2513 - protein, 4 aa, Unknown
  Description of Unknown: Linker sequence
QLRT

SEQ ID NO: 2514 - protein, 5 aa, Unknown
  Description of Unknown: Linker sequence
DITNA

SEQ ID NO: 2515 - protein, 6 aa, Unknown
  Description of Unknown: Linker sequence
QEVVAP

SEQ ID NO: 2516 - protein, 4 aa, Unknown
  Description of Unknown: Linker sequence
ILGE

SEQ ID NO: 2517 - protein, 5 aa, Unknown
  Description of Unknown: Linker sequence
SQGGK

SEQ ID NO: 2518 - protein, 6 aa, Unknown
  Description of Unknown: Linker sequence
IARPPA

SEQ ID NO: 2519 - protein, 7 aa, Unknown
  Description of Unknown: Linker sequence
PTFAVER

SEQ ID NO: 2520 - protein, 12 aa, Unknown
  Description of Unknown: Linker sequence
EGTYGDRPHRPY

SEQ ID NO: 2521 - protein, 24 aa, Unknown
  Description of Unknown: Linker sequence
YSGDLGNREKDVLPDPSLPPLADL

SEQ ID NO: 2522 - protein, 4 aa, Unknown
  Description of Unknown: Linker sequence
DYTE

SEQ ID NO: 2523 - protein, 4 aa, Unknown
  Description of Unknown: Linker sequence
TFSY

SEQ ID NO: 2524 - protein, 6 aa, Unknown
  Description of Unknown: Linker sequence
DTFIDH

SEQ ID NO: 2525 - protein, 8 aa, Unknown
  Description of Unknown: Linker sequence
EMGKYDNH

SEQ ID NO: 2526 - protein, 9 aa, Unknown
  Description of Unknown: Linker sequence
YGQFEPPAL

SEQ ID NO: 2527 - protein, 16 aa, Unknown
  Description of Unknown: Linker sequence
KYLVQNRVTGEIYESA

SEQ ID NO: 2528 - protein, 13 aa, Unknown
  Description of Unknown: Linker sequence
DLSVFPELEEGDY

SEQ ID NO: 2529 - protein, 9 aa, Unknown
  Description of Unknown: Linker sequence
DYGFIEPNE

SEQ ID NO: 2530 - protein, 5 aa, Unknown
  Description of Unknown: Linker sequence
PAPAP

SEQ ID NO: 2531 - protein, 10 aa, Unknown
  Description of Unknown: Linker sequence
APAPAPAPAP

SEQ ID NO: 2532 - protein, 12 aa, Unknown
  Description of Unknown: Linker sequence
APAPAPAPAPAP

SEQ ID NO: 2533 - protein, 14 aa, Unknown
  Description of Unknown: Linker sequence
APAPAPAPAPAPAP

SEQ ID NO: 2534 - protein, 16 aa, Unknown
  Description of Unknown: Linker sequence
APAPAPAPAPAPAPAP

SEQ ID NO: 2535 - protein, 18 aa, Unknown
  Description of Unknown: Linker sequence
APAPAPAPAPAPAPAPAP

SEQ ID NO: 2536 - protein, 20 aa, Unknown
  Description of Unknown: Linker sequence
APAPAPAPAPAPAPAPAPAP

SEQ ID NO: 2537 - protein, 22 aa, Unknown
  Description of Unknown: Linker sequence
APAPAPAPAPAPAPAPAPAPAP

SEQ ID NO: 2538 - protein, 24 aa, Unknown
  Description of Unknown: Linker sequence
APAPAPAPAPAPAPAPAPAPAPAP

SEQ ID NO: 2539 - protein, 26 aa, Unknown
  Description of Unknown: Linker sequence
APAPAPAPAPAPAPAPAPAPAPAPAP

SEQ ID NO: 2540 - protein, 28 aa, Unknown
  Description of Unknown: Linker sequence
APAPAPAPAPAPAPAPAPAPAPAPAPAP

SEQ ID NO: 2541 - protein, 30 aa, Unknown
  Description of Unknown: Linker sequence
APAPAPAPAPAPAPAPAPAPAPAPAPAPAP

SEQ ID NO: 2542 - protein, 32 aa, Unknown
  Description of Unknown: Linker sequence
APAPAPAPAPAPAPAPAPAPAPAPAPAPAPAP

SEQ ID NO: 2543 - protein, 33 aa, Unknown
  Description of Unknown: Linker sequence
EPEPEPEPIPEPPKEAPVVIEKPKPKPKPKPKP

SEQ ID NO: 2544 - protein, 34 aa, Unknown
  Description of Unknown: Linker sequence
APAPAPAPAPAPAPAPAPAPAPAPAPAPAPAPAP

SEQ ID NO: 2545 - protein, 5 aa, Unknown
  Description of Unknown: Linker sequence
EAAAK

SEQ ID NO: 2546 - protein, 10 aa, Unknown
  Description of Unknown: Linker sequence
EAAAKEAAAK

SEQ ID NO: 2547 - protein, 12 aa, Unknown
  Description of Unknown: Linker sequence
AEAAAKEAAAKA

SEQ ID NO: 2548 - protein, 15 aa, Unknown
  Description of Unknown: Linker sequence
EAAAKEAAAKEAAAK

SEQ ID NO: 2549 - protein, 17 aa, Unknown
  Description of Unknown: Linker sequence
AEAAAKEAAAKEAAAKA

SEQ ID NO: 2550 - protein, 22 aa, Unknown
  Description of Unknown: Linker sequence
AEAAAKEAAAKEAAAKEAAAKA

SEQ ID NO: 2551 - protein, 27 aa, Unknown
  Description of Unknown: Linker sequence
AEAAAKEAAAKEAAAKEAAAKEAAAKA

SEQ ID NO: 2552 - protein, 46 aa, Unknown
  Description of Unknown: Linker sequence
AEAAAKEAAAKEAAAKEAAAKALEAEAAAKEAAAKEAAAKEAAAKA

SEQ ID NO: 2553 - protein, 6 aa, Unknown
  Description of Unknown: Linker sequence
KSGEDI

SEQ ID NO: 2554 - protein, 29 aa, Unknown
  Description of Unknown: Linker sequence
INQGEDSVPAKKFKAAPAEISDGEDRSKC

SEQ ID NO: 2555 - protein, 5 aa, Unknown
  Description of Unknown: Linker sequence
RSPEW

SEQ ID NO: 2556 - protein, 19 aa, Unknown
  Description of Unknown: Linker sequence
SAFGIRPPLRLGEFTMPEH

SEQ ID NO: 2557 - protein, 12 aa, Unknown
  Description of Unknown: Linker sequence
LNTGASDNFTRW

SEQ ID NO: 2558 - protein, 12 aa, Unknown
  Description of Unknown: Linker sequence
AEKGEDIEIKKV

SEQ ID NO: 2559 - protein, 15 aa, Unknown
  Description of Unknown: Linker sequence
VDRADPLEQGAGDQG

SEQ ID NO: 2560 - protein, 4 aa, Unknown
  Description of Unknown: Linker sequence
DGDF

SEQ ID NO: 2561 - protein, 4 aa, Unknown
  Description of Unknown: Linker sequence
KNDK

SEQ ID NO: 2562 - protein, 4 aa, Unknown
  Description of Unknown: Linker sequence
PIRS

SEQ ID NO: 2563 - protein, 4 aa, Unknown
  Description of Unknown: Linker sequence
PMTG

SEQ ID NO: 2564 - protein, 4 aa, Unknown
  Description of Unknown: Linker sequence
RACC

SEQ ID NO: 2565 - protein, 4 aa, Unknown
  Description of Unknown: Linker sequence
VGTT

SEQ ID NO: 2566 - protein, 5 aa, Unknown
  Description of Unknown: Linker sequence
DAGIR

SEQ ID NO: 2567 - protein, 5 aa, Unknown
  Description of Unknown: Linker sequence
DDLPL

SEQ ID NO: 2568 - protein, 5 aa, Unknown
  Description of Unknown: Linker sequence
GCTSV

SEQ ID NO: 2569 - protein, 5 aa, Unknown
  Description of Unknown: Linker sequence
ITAFV

SEQ ID NO: 2570 - protein, 5 aa, Unknown
  Description of Unknown: Linker sequence
TASEM

SEQ ID NO: 2571 - protein, 5 aa, Unknown
  Description of Unknown: Linker sequence
TGDNK

SEQ ID NO: 2572 - protein, 5 aa, Unknown
  Description of Unknown: Linker sequence
YETDL

SEQ ID NO: 2573 - protein, 6 aa, Unknown
  Description of Unknown: Linker sequence
LADDNF

SEQ ID NO: 2574 - protein, 6 aa, Unknown
  Description of Unknown: Linker sequence
MGSGTA

SEQ ID NO: 2575 - protein, 7 aa, Unknown
  Description of Unknown: Linker sequence
ARVEPSH

SEQ ID NO: 2576 - protein, 7 aa, Unknown
  Description of Unknown: Linker sequence
EMVLDDS

SEQ ID NO: 2577 - protein, 7 aa, Unknown
  Description of Unknown: Linker sequence
RDTPPKR

SEQ ID NO: 2578 - protein, 7 aa, Unknown
  Description of Unknown: Linker sequence
TGRDTLR

SEQ ID NO: 2579 - protein, 8 aa, Unknown
  Description of Unknown: Linker sequence
LDPPRKEV

SEQ ID NO: 2580 - protein, 9 aa, Unknown
  Description of Unknown: Linker sequence
LAWFEEGEE

SEQ ID NO: 2581 - protein, 10 aa, Unknown
  Description of Unknown: Linker sequence
ALGLPEALIP

SEQ ID NO: 2582 - protein, 12 aa, Unknown
  Description of Unknown: Linker sequence
DKTGTLTTNQMS

SEQ ID NO: 2583 - protein, 12 aa, Unknown
  Description of Unknown: Linker sequence
ITGSTYAPEGEV

SEQ ID NO: 2584 - protein, 14 aa, Unknown
  Description of Unknown: Linker sequence
IGIFGENEEVADRA

SEQ ID NO: 2585 - protein, 6 aa, Unknown
  Description of Unknown: Linker sequence
YLRQDL

SEQ ID NO: 2586 - protein, 8 aa, Unknown
  Description of Unknown: Linker sequence
ESQSLSIQ

SEQ ID NO: 2587 - protein, 6 aa, Unknown
  Description of Unknown: Linker sequence
SGKQSY

SEQ ID NO: 2588 - protein, 14 aa, Unknown
  Description of Unknown: Linker sequence
FRARGKAVSTVFDQ

SEQ ID NO: 2589 - protein, 6 aa, Unknown
  Description of Unknown: Linker sequence
DANSEM

SEQ ID NO: 2590 - protein, 7 aa, Unknown
  Description of Unknown: Linker sequence
DITAQKE

SEQ ID NO: 2591 - protein, 8 aa, Unknown
  Description of Unknown: Linker sequence
TVESTGKV

SEQ ID NO: 2592 - protein, 5 aa, Unknown
  Description of Unknown: Linker sequence
AQDRK

SEQ ID NO: 2593 - protein, 4 aa, Unknown
  Description of Unknown: Linker sequence
FYGK

SEQ ID NO: 2594 - protein, 8 aa, Unknown
  Description of Unknown: Linker sequence
ALSSTGEI

SEQ ID NO: 2595 - protein, 15 aa, Unknown
  Description of Unknown: Linker sequence
TATPPGSVTVPHPNI

SEQ ID NO: 2596 - protein, 5 aa, Unknown
  Description of Unknown: Linker sequence
SSSSG

SEQ ID NO: 2597 - protein, 10 aa, Unknown
  Description of Unknown: Linker sequence
SSSSGSSSSG

SEQ ID NO: 2598 - protein, 13 aa, Unknown
  Description of Unknown: Linker sequence
SGSSSSGSSSSGS

SEQ ID NO: 2599 - protein, 15 aa, Unknown
  Description of Unknown: Linker sequence
SSSSGSSSSGSSSSG

SEQ ID NO: 2600 - protein, 19 aa, Unknown
  Description of Unknown: Linker sequence
SVTVSSSGSSSSGSSSSGS

SEQ ID NO: 2601 - protein, 20 aa, Unknown
  Description of Unknown: Linker sequence
SSSSGSSSSGSSSSGSSSSG

SEQ ID NO: 2602 - protein, 25 aa, Unknown
  Description of Unknown: Linker sequence
SSSSGSSSSGSSSSGSSSSGSSSSG

SEQ ID NO: 2603 - protein, 17 aa, Unknown
  Description of Unknown: Linker sequence
LLQVPLPPWPGAPVGGE

SEQ ID NO: 2604 - protein, 6 aa, Unknown
  Description of Unknown: Linker sequence
FRGPDR

SEQ ID NO: 2605 - protein, 4 aa, Unknown
  Description of Unknown: Linker sequence
EGGK

SEQ ID NO: 2606 - protein, 6 aa, Unknown
  Description of Unknown: Linker sequence
INDKYE

SEQ ID NO: 2607 - protein, 6 aa, Unknown
  Description of Unknown: Linker sequence
NETTNK

SEQ ID NO: 2608 - protein, 8 aa, Unknown
  Description of Unknown: Linker sequence
DFDSGSLR

SEQ ID NO: 2609 - protein, 9 aa, Unknown
  Description of Unknown: Linker sequence
KNGDNDFRY

SEQ ID NO: 2610 - protein, 11 aa, Unknown
  Description of Unknown: Linker sequence
PMNVFYKDSLF

SEQ ID NO: 2611 - protein, 4 aa, Unknown
  Description of Unknown: Linker sequence
GGEA

SEQ ID NO: 2612 - protein, 4 aa, Unknown
  Description of Unknown: Linker sequence
LGDV

SEQ ID NO: 2613 - protein, 5 aa, Unknown
  Description of Unknown: Linker sequence
YSNVE

SEQ ID NO: 2614 - protein, 6 aa, Unknown
  Description of Unknown: Linker sequence
DPVSKE

SEQ ID NO: 2615 - protein, 6 aa, Unknown
  Description of Unknown: Linker sequence
GLPGDK

SEQ ID NO: 2616 - protein, 6 aa, Unknown
  Description of Unknown: Linker sequence
IVPPGQ

SEQ ID NO: 2617 - protein, 9 aa, Unknown
  Description of Unknown: Linker sequence
TVPIAQDQV

SEQ ID NO: 2618 - protein, 11 aa, Unknown
  Description of Unknown: Linker sequence
EVPKNETKENG

SEQ ID NO: 2619 - protein, 12 aa, Unknown
  Description of Unknown: Linker sequence
MYYQQPGQQLAT

SEQ ID NO: 2620 - protein, 16 aa, Unknown
  Description of Unknown: Linker sequence
QPGCSSGQACENALPV

SEQ ID NO: 2621 - protein, 15 aa, Unknown
  Description of Unknown: Linker sequence
ALGGEARLPVLKDRN

SEQ ID NO: 2622 - protein, 8 aa, Unknown
  Description of Unknown: Linker sequence
KYTYEHDP

SEQ ID NO: 2623 - protein, 10 aa, Unknown
  Description of Unknown: Linker sequence
IGGPPNACLD

SEQ ID NO: 2624 - protein, 20 aa, Unknown
  Description of Unknown: Linker sequence
ENAQRFNQAQSGNIQSTVML

SEQ ID NO: 2625 - protein, 25 aa, Unknown
  Description of Unknown: Linker sequence
LQNREHETNGVAKSDQKQEQLLLKK

SEQ ID NO: 2626 - protein, 9 aa, Unknown
  Description of Unknown: Linker sequence
CEMGSTFQL

SEQ ID NO: 2627 - protein, 26 aa, Unknown
  Description of Unknown: Linker sequence
PDGRNQNPDLTGLCEPTPQDHIKVTQ

SEQ ID NO: 2628 - protein, 4 aa, Unknown
  Description of Unknown: Linker sequence
LGTA

SEQ ID NO: 2629 - protein, 4 aa, Unknown
  Description of Unknown: Linker sequence
NHPA

SEQ ID NO: 2630 - protein, 5 aa, Unknown
  Description of Unknown: Linker sequence
CNLTP

SEQ ID NO: 2631 - protein, 5 aa, Unknown
  Description of Unknown: Linker sequence
IRRTS

SEQ ID NO: 2632 - protein, 6 aa, Unknown
  Description of Unknown: Linker sequence
KYLPVK

SEQ ID NO: 2633 - protein, 7 aa, Unknown
  Description of Unknown: Linker sequence
ISGTPIQ

SEQ ID NO: 2634 - protein, 8 aa, Unknown
  Description of Unknown: Linker sequence
RDADASDK

SEQ ID NO: 2635 - protein, 9 aa, Unknown
  Description of Unknown: Linker sequence
TGEEGFDGA

SEQ ID NO: 2636 - protein, 10 aa, Unknown
  Description of Unknown: Linker sequence
ESLQTGKISV

SEQ ID NO: 2637 - protein, 14 aa, Unknown
  Description of Unknown: Linker sequence
DLFPQNYSTKAVEP

SEQ ID NO: 2638 - protein, 4 aa, Unknown
  Description of Unknown: Linker sequence
SATH

SEQ ID NO: 2639 - protein, 7 aa, Unknown
  Description of Unknown: Linker sequence
YIPLPEP

SEQ ID NO: 2640 - protein, 8 aa, Unknown
  Description of Unknown: Linker sequence
RKTDGYSG

SEQ ID NO: 2641 - protein, 9 aa, Unknown
  Description of Unknown: Linker sequence
PSRADPNHL

SEQ ID NO: 2642 - protein, 10 aa, Unknown
  Description of Unknown: Linker sequence
LGTTQNSLTE

SEQ ID NO: 2643 - protein, 9 aa, Unknown
  Description of Unknown: Linker sequence
NLLGQQPLV

SEQ ID NO: 2644 - protein, 10 aa, Unknown
  Description of Unknown: Linker sequence
SSYGPASGPL

SEQ ID NO: 2645 - protein, 11 aa, Unknown
  Description of Unknown: Linker sequence
VAQLPKKQVYI

SEQ ID NO: 2646 - protein, 16 aa, Unknown
  Description of Unknown: Linker sequence
SATPQGQTAKIEVPHT

SEQ ID NO: 2647 - protein, 4 aa, Unknown
  Description of Unknown: Linker sequence
FSCS

SEQ ID NO: 2648 - protein, 8 aa, Unknown
  Description of Unknown: Linker sequence
FWLAIDMS

SEQ ID NO: 2649 - protein, 9 aa, Unknown
  Description of Unknown: Linker sequence
VKAAPQAPV

SEQ ID NO: 2650 - protein, 13 aa, Unknown
  Description of Unknown: Linker sequence
ADQSESQMIPKDS

SEQ ID NO: 2651 - protein, 4 aa, Unknown
  Description of Unknown: Linker sequence
FAFI

SEQ ID NO: 2652 - protein, 4 aa, Unknown
  Description of Unknown: Linker sequence
IQNT

SEQ ID NO: 2653 - protein, 5 aa, Unknown
  Description of Unknown: Linker sequence
GTLSP

SEQ ID NO: 2654 - protein, 6 aa, Unknown
  Description of Unknown: Linker sequence
QVPQDD

SEQ ID NO: 2655 - protein, 8 aa, Unknown
  Description of Unknown: Linker sequence
HLSAGCPH

SEQ ID NO: 2656 - protein, 11 aa, Unknown
  Description of Unknown: Linker sequence
FSTRVLPAQAT

SEQ ID NO: 2657 - protein, 4 aa, Unknown
  Description of Unknown: Linker sequence
EMDS

SEQ ID NO: 2658 - protein, 5 aa, Unknown
  Description of Unknown: Linker sequence
HFPLK

SEQ ID NO: 2659 - protein, 6 aa, Unknown
  Description of Unknown: Linker sequence
DLDNVT

SEQ ID NO: 2660 - protein, 6 aa, Unknown
  Description of Unknown: Linker sequence
FDGQLE

SEQ ID NO: 2661 - protein, 7 aa, Unknown
  Description of Unknown: Linker sequence
ITNECQW

SEQ ID NO: 2662 - protein, 7 aa, Unknown
  Description of Unknown: Linker sequence
SQPFPVV

SEQ ID NO: 2663 - protein, 7 aa, Unknown
  Description of Unknown: Linker sequence
TGARSNF

SEQ ID NO: 2664 - protein, 8 aa, Unknown
  Description of Unknown: Linker sequence
ESDASNPF

SEQ ID NO: 2665 - protein, 8 aa, Unknown
  Description of Unknown: Linker sequence
HFFGNRSI

SEQ ID NO: 2666 - protein, 9 aa, Unknown
  Description of Unknown: Linker sequence
QPIYPATLT

SEQ ID NO: 2667 - protein, 10 aa, Unknown
  Description of Unknown: Linker sequence
FLAGTRKCSV

SEQ ID NO: 2668 - protein, 12 aa, Unknown
  Description of Unknown: Linker sequence
LNPQHSAPKPNV

SEQ ID NO: 2669 - protein, 12 aa, Unknown
  Description of Unknown: Linker sequence
SKGKQLGENQLV

SEQ ID NO: 2670 - protein, 15 aa, Unknown
  Description of Unknown: Linker sequence
ATKQDPVRPKRPLSS

SEQ ID NO: 2671 - protein, 16 aa, Unknown
  Description of Unknown: Linker sequence
ICDSHPTNKNNPTTPL

SEQ ID NO: 2672 - protein, 9 aa, Unknown
  Description of Unknown: Linker sequence
YLDTKPAPV

SEQ ID NO: 2673 - protein, 4 aa, Unknown
  Description of Unknown: Linker sequence
IHKK

SEQ ID NO: 2674 - protein, 5 aa, Unknown
  Description of Unknown: Linker sequence
GIMPG

SEQ ID NO: 2675 - protein, 5 aa, Unknown
  Description of Unknown: Linker sequence
NPGEC

SEQ ID NO: 2676 - protein, 7 aa, Unknown
  Description of Unknown: Linker sequence
IGPNCPG

SEQ ID NO: 2677 - protein, 8 aa, Unknown
  Description of Unknown: Linker sequence
CITEGIPQ

SEQ ID NO: 2678 - protein, 8 aa, Unknown
  Description of Unknown: Linker sequence
LLRQGKTR

SEQ ID NO: 2679 - protein, 4 aa, Unknown
  Description of Unknown: Linker sequence
MRDQ

SEQ ID NO: 2680 - protein, 4 aa, Unknown
  Description of Unknown: Linker sequence
QEDP

SEQ ID NO: 2681 - protein, 5 aa, Unknown
  Description of Unknown: Linker sequence
CLDGK

SEQ ID NO: 2682 - protein, 5 aa, Unknown
  Description of Unknown: Linker sequence
QWELN

SEQ ID NO: 2683 - protein, 6 aa, Unknown
  Description of Unknown: Linker sequence
ALDGNI

SEQ ID NO: 2684 - protein, 6 aa, Unknown
  Description of Unknown: Linker sequence
TKQGDL

SEQ ID NO: 2685 - protein, 31 aa, Unknown
  Description of Unknown: Linker sequence
KGEKYEKRIERLSVRKEEDVKTRSGKLGDNV

SEQ ID NO: 2686 - protein, 27 aa, Unknown
  Description of Unknown: Linker sequence
AEDRPLSRELPAPAGGPVALSLHDEPT

SEQ ID NO: 2687 - protein, 9 aa, Unknown
  Description of Unknown: Linker sequence
PYQKTSIPK

SEQ ID NO: 2688 - protein, 9 aa, Unknown
  Description of Unknown: Linker sequence
RGAGKPNSS

SEQ ID NO: 2689 - protein, 6 aa, Unknown
  Description of Unknown: Linker sequence
AVGKNP

SEQ ID NO: 2690 - protein, 6 aa, Unknown
  Description of Unknown: Linker sequence
DTATNT

SEQ ID NO: 2691 - protein, 6 aa, Unknown
  Description of Unknown: Linker sequence
FLSEPV

SEQ ID NO: 2692 - protein, 6 aa, Unknown
  Description of Unknown: Linker sequence
LSFCNT

SEQ ID NO: 2693 - protein, 7 aa, Unknown
  Description of Unknown: Linker sequence
SNITSGY

SEQ ID NO: 2694 - protein, 7 aa, Unknown
  Description of Unknown: Linker sequence
VTPDGKK

SEQ ID NO: 2695 - protein, 7 aa, Unknown
  Description of Unknown: Linker sequence
YASGQFI

SEQ ID NO: 2696 - protein, 13 aa, Unknown
  Description of Unknown: Linker sequence
SIPVQPVYPSADF

SEQ ID NO: 2697 - protein, 7 aa, Unknown
  Description of Unknown: Linker sequence
EIPTSNI

SEQ ID NO: 2698 - protein, 8 aa, Unknown
  Description of Unknown: Linker sequence
KADFPTPS

SEQ ID NO: 2699 - protein, 10 aa, Unknown
  Description of Unknown: Linker sequence
HPYIQNPDPA

SEQ ID NO: 2700 - protein, 11 aa, Unknown
  Description of Unknown: Linker sequence
DTPPNFLDDDM

SEQ ID NO: 2701 - protein, 7 aa, Unknown
  Description of Unknown: Linker sequence
FCKALNP

SEQ ID NO: 2702 - protein, 13 aa, Unknown
  Description of Unknown: Linker sequence
HHDYSLPAAGESW

SEQ ID NO: 2703 - protein, 4 aa, Unknown
  Description of Unknown: Linker sequence
AEGV

SEQ ID NO: 2704 - protein, 7 aa, Unknown
  Description of Unknown: Linker sequence
LMLIADV

SEQ ID NO: 2705 - protein, 8 aa, Unknown
  Description of Unknown: Linker sequence
EAGEEGEK

SEQ ID NO: 2706 - protein, 22 aa, Unknown
  Description of Unknown: Linker sequence
RSTPPPEMPKPVPRKEVQAGVE

SEQ ID NO: 2707 - protein, 6 aa, Unknown
  Description of Unknown: Linker sequence
CVPLVR

SEQ ID NO: 2708 - protein, 6 aa, Unknown
  Description of Unknown: Linker sequence
KSDPIQ

SEQ ID NO: 2709 - protein, 4 aa, Unknown
  Description of Unknown: Linker sequence
AGVE

SEQ ID NO: 2710 - protein, 12 aa, Unknown
  Description of Unknown: Linker sequence
NAGGELFRDVNV

SEQ ID NO: 2711 - protein, 17 aa, Unknown
  Description of Unknown: Linker sequence
ERGAWSAPLPRQPRADT

SEQ ID NO: 2712 - protein, 19 aa, Unknown
  Description of Unknown: Linker sequence
LAGQQLEHGQTRRFGAISQ

SEQ ID NO: 2713 - protein, 4 aa, Unknown
  Description of Unknown: Linker sequence
IDNG

SEQ ID NO: 2714 - protein, 4 aa, Unknown
  Description of Unknown: Linker sequence
KVSW

SEQ ID NO: 2715 - protein, 5 aa, Unknown
  Description of Unknown: Linker sequence
NRGES

SEQ ID NO: 2716 - protein, 6 aa, Unknown
  Description of Unknown: Linker sequence
ITAKDE

SEQ ID NO: 2717 - protein, 6 aa, Unknown
  Description of Unknown: Linker sequence
LWPHTK

SEQ ID NO: 2718 - protein, 6 aa, Unknown
  Description of Unknown: Linker sequence
MAIGPV

SEQ ID NO: 2719 - protein, 8 aa, Unknown
  Description of Unknown: Linker sequence
AEKNYDVI

SEQ ID NO: 2720 - protein, 8 aa, Unknown
  Description of Unknown: Linker sequence
DLDRTLTQ

SEQ ID NO: 2721 - protein, 9 aa, Unknown
  Description of Unknown: Linker sequence
NIAHDDKPG

SEQ ID NO: 2722 - protein, 4 aa, Unknown
  Description of Unknown: Linker sequence
FFDK

SEQ ID NO: 2723 - protein, 6 aa, Unknown
  Description of Unknown: Linker sequence
LFSNDE

SEQ ID NO: 2724 - protein, 6 aa, Unknown
  Description of Unknown: Linker sequence
VTPGSE

SEQ ID NO: 2725 - protein, 7 aa, Unknown
  Description of Unknown: Linker sequence
ERKERDH

SEQ ID NO: 2726 - protein, 12 aa, Unknown
  Description of Unknown: Linker sequence
FDIDQNISSDDF

SEQ ID NO: 2727 - protein, 17 aa, Unknown
  Description of Unknown: Linker sequence
ELIDAIPEDENVTLYSQ

SEQ ID NO: 2728 - protein, 19 aa, Unknown
  Description of Unknown: Linker sequence
TMKQIVNENMKIERKVVSR

SEQ ID NO: 2729 - protein, 23 aa, Unknown
  Description of Unknown: Linker sequence
AHAIKRLYGNVKFGVGPVIEGGF

SEQ ID NO: 2730 - protein, 21 aa, Unknown
  Description of Unknown: Linker sequence
INGGWGPWSPWDICSVTCGGG

SEQ ID NO: 2731 - protein, 16 aa, Unknown
  Description of Unknown: Linker sequence
LKMKGLTYTMCDKTKF

SEQ ID NO: 2732 - protein, 7 aa, Unknown
  Description of Unknown: Linker sequence
LRGEVVS

SEQ ID NO: 2733 - protein, 10 aa, Unknown
  Description of Unknown: Linker sequence
IHLPKTLEGM

SEQ ID NO: 2734 - protein, 4 aa, Unknown
  Description of Unknown: Linker sequence
PYPV

SEQ ID NO: 2735 - protein, 14 aa, Unknown
  Description of Unknown: Linker sequence
LNKEGEPTKQRTRD

SEQ ID NO: 2736 - protein, 11 aa, Unknown
  Description of Unknown: Linker sequence
RFRDRLPEKLR

SEQ ID NO: 2737 - protein, 12 aa, Unknown
  Description of Unknown: Linker sequence
DAPQQDPEGNKT

SEQ ID NO: 2738 - protein, 4 aa, Unknown
  Description of Unknown: Linker sequence
ELPL

SEQ ID NO: 2739 - protein, 4 aa, Unknown
  Description of Unknown: Linker sequence
VHGK

SEQ ID NO: 2740 - protein, 5 aa, Unknown
  Description of Unknown: Linker sequence
TNTEK

SEQ ID NO: 2741 - protein, 9 aa, Unknown
  Description of Unknown: Linker sequence
DSPLKYWPK

SEQ ID NO: 2742 - protein, 12 aa, Unknown
  Description of Unknown: Linker sequence
SCSEPRCFNGGT

SEQ ID NO: 2743 - protein, 4 aa, Unknown
  Description of Unknown: Linker sequence
IDGK

SEQ ID NO: 2744 - protein, 5 aa, Unknown
  Description of Unknown: Linker sequence
PLEGT

SEQ ID NO: 2745 - protein, 9 aa, Unknown
  Description of Unknown: Linker sequence
AMPGWQDKV

SEQ ID NO: 2746 - protein, 8 aa, Unknown
  Description of Unknown: Linker sequence
YKKTARPK

SEQ ID NO: 2747 - protein, 12 aa, Unknown
  Description of Unknown: Linker sequence
TWAPHPRPLPQA

SEQ ID NO: 2748 - protein, 7 aa, Unknown
  Description of Unknown: Linker sequence
ELNEEMP

SEQ ID NO: 2749 - protein, 17 aa, Unknown
  Description of Unknown: Linker sequence
IVDYSPQQEGKVFFGAW

SEQ ID NO: 2750 - protein, 6 aa, Unknown
  Description of Unknown: Linker sequence
QRVRNR

SEQ ID NO: 2751 - protein, 5 aa, Unknown
  Description of Unknown: Linker sequence
LFVKP

SEQ ID NO: 2752 - protein, 6 aa, Unknown
  Description of Unknown: Linker sequence
NLNLTP

SEQ ID NO: 2753 - protein, 18 aa, Unknown
  Description of Unknown: Linker sequence
YSKKAPPQEEIEFVGEHP

SEQ ID NO: 2754 - protein, 4 aa, Unknown
  Description of Unknown: Linker sequence
IHSP

SEQ ID NO: 2755 - protein, 4 aa, Unknown
  Description of Unknown: Linker sequence
LTDS

SEQ ID NO: 2756 - protein, 5 aa, Unknown
  Description of Unknown: Linker sequence
KDGRL

SEQ ID NO: 2757 - protein, 9 aa, Unknown
  Description of Unknown: Linker sequence
ARINEREET

SEQ ID NO: 2758 - protein, 19 aa, Unknown
  Description of Unknown: Linker sequence
LWNCAPPQSEVVYRPLVSL

SEQ ID NO: 2759 - protein, 5 aa, Unknown
  Description of Unknown: Linker sequence
EFPEV

SEQ ID NO: 2760 - protein, 7 aa, Unknown
  Description of Unknown: Linker sequence
RTASHSI

SEQ ID NO: 2761 - protein, 21 aa, Unknown
  Description of Unknown: Linker sequence
EDGVIRRRVALLDPVKVNTKV

SEQ ID NO: 2762 - protein, 9 aa, Unknown
  Description of Unknown: Linker sequence
VLAGGKSGV

SEQ ID NO: 2763 - protein, 4 aa, Unknown
  Description of Unknown: Linker sequence
QKHV

SEQ ID NO: 2764 - protein, 5 aa, Unknown
  Description of Unknown: Linker sequence
VAPLI

SEQ ID NO: 2765 - protein, 6 aa, Unknown
  Description of Unknown: Linker sequence
AADTGL

SEQ ID NO: 2766 - protein, 6 aa, Unknown
  Description of Unknown: Linker sequence
FANDPQ

SEQ ID NO: 2767 - protein, 6 aa, Unknown
  Description of Unknown: Linker sequence
LLDHHQ

SEQ ID NO: 2768 - protein, 9 aa, Unknown
  Description of Unknown: Linker sequence
SSPHALGVI

SEQ ID NO: 2769 - protein, 11 aa, Unknown
  Description of Unknown: Linker sequence
SERSFPDDLNM

SEQ ID NO: 2770 - protein, 21 aa, Unknown
  Description of Unknown: Linker sequence
DMGYLGPDPVARSLRTRRAGA

SEQ ID NO: 2771 - protein, 4 aa, Unknown
  Description of Unknown: Linker sequence
ELPL

SEQ ID NO: 2772 - protein, 5 aa, Unknown
  Description of Unknown: Linker sequence
EMPSL

SEQ ID NO: 2773 - protein, 5 aa, Unknown
  Description of Unknown: Linker sequence
RREDI

SEQ ID NO: 2774 - protein, 8 aa, Unknown
  Description of Unknown: Linker sequence
IHYDWPGN

SEQ ID NO: 2775 - protein, 9 aa, Unknown
  Description of Unknown: Linker sequence
LLTGEYISE

SEQ ID NO: 2776 - protein, 11 aa, Unknown
  Description of Unknown: Linker sequence
RNRKVVKGFTP

SEQ ID NO: 2777 - protein, 17 aa, Unknown
  Description of Unknown: Linker sequence
IAATPIKTEYSGEIQPL

SEQ ID NO: 2778 - protein, 4 aa, Unknown
  Description of Unknown: Linker sequence
NQYR

SEQ ID NO: 2779 - protein, 7 aa, Unknown
  Description of Unknown: Linker sequence
EMGLSLQ

SEQ ID NO: 2780 - protein, 7 aa, Unknown
  Description of Unknown: Linker sequence
KDSAQNS

SEQ ID NO: 2781 - protein, 11 aa, Unknown
  Description of Unknown: Linker sequence
HDVELNLDYEE

SEQ ID NO: 2782 - protein, 5 aa, Unknown
  Description of Unknown: Linker sequence
PVDAQ

SEQ ID NO: 2783 - protein, 5 aa, Unknown
  Description of Unknown: Linker sequence
VPIIE

SEQ ID NO: 2784 - protein, 7 aa, Unknown
  Description of Unknown: Linker sequence
GVFDGGK

SEQ ID NO: 2785 - protein, 4 aa, Unknown
  Description of Unknown: Linker sequence
YLRE

SEQ ID NO: 2786 - protein, 6 aa, Unknown
  Description of Unknown: Linker sequence
IEEDSP

SEQ ID NO: 2787 - protein, 5 aa, Unknown
  Description of Unknown: Linker sequence
RKSFL

SEQ ID NO: 2788 - protein, 7 aa, Unknown
  Description of Unknown: Linker sequence
DILDDDR

SEQ ID NO: 2789 - protein, 7 aa, Unknown
  Description of Unknown: Linker sequence
SGKGGDK

SEQ ID NO: 2790 - protein, 15 aa, Unknown
  Description of Unknown: Linker sequence
MGGTFTDKDPFRSGR

SEQ ID NO: 2791 - protein, 4 aa, Unknown
  Description of Unknown: Linker sequence
VEER

SEQ ID NO: 2792 - protein, 7 aa, Unknown
  Description of Unknown: Linker sequence
ELPELTA

SEQ ID NO: 2793 - protein, 11 aa, Unknown
  Description of Unknown: Linker sequence
IKRFGVEDGSV

SEQ ID NO: 2794 - protein, 4 aa, Unknown
  Description of Unknown: Linker sequence
AYRW

SEQ ID NO: 2795 - protein, 4 aa, Unknown
  Description of Unknown: Linker sequence
EDAL

SEQ ID NO: 2796 - protein, 7 aa, Unknown
  Description of Unknown: Linker sequence
IRTVGEA

SEQ ID NO: 2797 - protein, 15 aa, Unknown
  Description of Unknown: Linker sequence
ETGLNAYLPGLAGKE

SEQ ID NO: 2798 - protein, 9 aa, Unknown
  Description of Unknown: Linker sequence
LEGRIKGKE

SEQ ID NO: 2799 - protein, 5 aa, Unknown
  Description of Unknown: Linker sequence
RMRNF

SEQ ID NO: 2800 - protein, 6 aa, Unknown
  Description of Unknown: Linker sequence
RGVLPE

SEQ ID NO: 2801 - protein, 6 aa, Unknown
  Description of Unknown: Linker sequence
SLEEQR

SEQ ID NO: 2802 - protein, 7 aa, Unknown
  Description of Unknown: Linker sequence
ANQLQNY

SEQ ID NO: 2803 - protein, 7 aa, Unknown
  Description of Unknown: Linker sequence
NYLLPAG

SEQ ID NO: 2804 - protein, 14 aa, Unknown
  Description of Unknown: Linker sequence
LDWQPRENPFQNLK

SEQ ID NO: 2805 - protein, 4 aa, Unknown
  Description of Unknown: Linker sequence
RIQM

SEQ ID NO: 2806 - protein, 4 aa, Unknown
  Description of Unknown: Linker sequence
WTDP

SEQ ID NO: 2807 - protein, 5 aa, Unknown
  Description of Unknown: Linker sequence
ELGLL

SEQ ID NO: 2808 - protein, 7 aa, Unknown
  Description of Unknown: Linker sequence
APSHGQI

SEQ ID NO: 2809 - protein, 8 aa, Unknown
  Description of Unknown: Linker sequence
ATGMVDER

SEQ ID NO: 2810 - protein, 5 aa, Unknown
  Description of Unknown: Linker sequence
FSLDE

SEQ ID NO: 2811 - protein, 6 aa, Unknown
  Description of Unknown: Linker sequence
HWKLEA

SEQ ID NO: 2812 - protein, 4 aa, Unknown
  Description of Unknown: Linker sequence
SEIG

SEQ ID NO: 2813 - protein, 8 aa, Unknown
  Description of Unknown: Linker sequence
KGIGHSRF

SEQ ID NO: 2814 - protein, 5 aa, Unknown
  Description of Unknown: Linker sequence
EGIKD

SEQ ID NO: 2815 - protein, 7 aa, Unknown
  Description of Unknown: Linker sequence
LSRFPTP

SEQ ID NO: 2816 - protein, 15 aa, Unknown
  Description of Unknown: Linker sequence
LLSPYHHVSGYSPRY

SEQ ID NO: 2817 - protein, 4 aa, Unknown
  Description of Unknown: Linker sequence
PGDW

SEQ ID NO: 2818 - protein, 6 aa, Unknown
  Description of Unknown: Linker sequence
DINKNE

SEQ ID NO: 2819 - protein, 6 aa, Unknown
  Description of Unknown: Linker sequence
ITPYAE

SEQ ID NO: 2820 - protein, 7 aa, Unknown
  Description of Unknown: Linker sequence
EFQSIGD

SEQ ID NO: 2821 - protein, 7 aa, Unknown
  Description of Unknown: Linker sequence
KDPEGNV

SEQ ID NO: 2822 - protein, 7 aa, Unknown
  Description of Unknown: Linker sequence
SLSVIGE

SEQ ID NO: 2823 - protein, 7 aa, Unknown
  Description of Unknown: Linker sequence
SPVNSKR

SEQ ID NO: 2824 - protein, 8 aa, Unknown
  Description of Unknown: Linker sequence
ENTRGFHG

SEQ ID NO: 2825 - protein, 8 aa, Unknown
  Description of Unknown: Linker sequence
NNLKRDYT

SEQ ID NO: 2826 - protein, 10 aa, Unknown
  Description of Unknown: Linker sequence
KYEDFRSPSA

SEQ ID NO: 2827 - protein, 24 aa, Unknown
  Description of Unknown: Linker sequence
YPRLTNKIPKPPQEVKPHPYGVDR

SEQ ID NO: 2828 - protein, 7 aa, Unknown
  Description of Unknown: Linker sequence
ARDRSYE

SEQ ID NO: 2829 - protein, 13 aa, Unknown
  Description of Unknown: Linker sequence
VTSTVKNDIYAHI

SEQ ID NO: 2830 - protein, 22 aa, Unknown
  Description of Unknown: Linker sequence
PYSERYGYRPALIPRPVMAGTL

SEQ ID NO: 2831 - protein, 5 aa, Unknown
  Description of Unknown: Linker sequence
VSQPG

SEQ ID NO: 2832 - protein, 6 aa, Unknown
  Description of Unknown: Linker sequence
LEGLPY

SEQ ID NO: 2833 - protein, 4 aa, Unknown
  Description of Unknown: Linker sequence
QPGV

SEQ ID NO: 2834 - protein, 5 aa, Unknown
  Description of Unknown: Linker sequence
WKLEG

SEQ ID NO: 2835 - protein, 6 aa, Unknown
  Description of Unknown: Linker sequence
TAYNAP

SEQ ID NO: 2836 - protein, 11 aa, Unknown
  Description of Unknown: Linker sequence
HKHDLSETNVY

SEQ ID NO: 2837 - protein, 7 aa, Unknown
  Description of Unknown: Linker sequence
VLQAVTD

SEQ ID NO: 2838 - protein, 4 aa, Unknown
  Description of Unknown: Linker sequence
YKDK

SEQ ID NO: 2839 - protein, 6 aa, Unknown
  Description of Unknown: Linker sequence
NLPFNM

SEQ ID NO: 2840 - protein, 6 aa, Unknown
  Description of Unknown: Linker sequence
WGVKDP

SEQ ID NO: 2841 - protein, 13 aa, Unknown
  Description of Unknown: Linker sequence
QKKKYGDKVPENL

SEQ ID NO: 2842 - protein, 14 aa, Unknown
  Description of Unknown: Linker sequence
NDLVEFNRFTNSPL

SEQ ID NO: 2843 - protein, 10 aa, Unknown
  Description of Unknown: Linker sequence
LKEQESPVKV

SEQ ID NO: 2844 - protein, 6 aa, Unknown
  Description of Unknown: Linker sequence
EEGIAN

SEQ ID NO: 2845 - protein, 11 aa, Unknown
  Description of Unknown: Linker sequence
ADFQGAGRRFD

SEQ ID NO: 2846 - protein, 6 aa, Unknown
  Description of Unknown: Linker sequence
AAGLPR

SEQ ID NO: 2847 - protein, 10 aa, Unknown
  Description of Unknown: Linker sequence
TFTGLPHRFE

SEQ ID NO: 2848 - protein, 4 aa, Unknown
  Description of Unknown: Linker sequence
TTVD

SEQ ID NO: 2849 - protein, 4 aa, Unknown
  Description of Unknown: Linker sequence
DNLR

SEQ ID NO: 2850 - protein, 5 aa, Unknown
  Description of Unknown: Linker sequence
FYHEP

SEQ ID NO: 2851 - protein, 6 aa, Unknown
  Description of Unknown: Linker sequence
ALGYPL

SEQ ID NO: 2852 - protein, 6 aa, Unknown
  Description of Unknown: Linker sequence
LLGEIS

SEQ ID NO: 2853 - protein, 6 aa, Unknown
  Description of Unknown: Linker sequence
MGTVGN

SEQ ID NO: 2854 - protein, 6 aa, Unknown
  Description of Unknown: Linker sequence
TGTNGK

SEQ ID NO: 2855 - protein, 10 aa, Unknown
  Description of Unknown: Linker sequence
RLQPVCGRME

SEQ ID NO: 2856 - protein, 12 aa, Unknown
  Description of Unknown: Linker sequence
TSEAHEKPEEKR

SEQ ID NO: 2857 - protein, 16 aa, Unknown
  Description of Unknown: Linker sequence
NFGGYFPNKLAEYHDF

SEQ ID NO: 2858 - protein, 15 aa, Unknown
  Description of Unknown: Linker sequence
RFAPPTWERIYPLDL

SEQ ID NO: 2859 - protein, 4 aa, Unknown
  Description of Unknown: Linker sequence
VFQP

SEQ ID NO: 2860 - protein, 13 aa, Unknown
  Description of Unknown: Linker sequence
EKASPAFYPQGQE

SEQ ID NO: 2861 - protein, 35 aa, Unknown
  Description of Unknown: Linker sequence
SMAVRFAKVPPDAAKAFIADRSMLFNGGTASRPPV

SEQ ID NO: 2862 - protein, 4 aa, Unknown
  Description of Unknown: Linker sequence
VLKL

SEQ ID NO: 2863 - protein, 6 aa, Unknown
  Description of Unknown: Linker sequence
DLKNSK

SEQ ID NO: 2864 - protein, 9 aa, Unknown
  Description of Unknown: Linker sequence
LKKDFQGVE

SEQ ID NO: 2865 - protein, 4 aa, Unknown
  Description of Unknown: Linker sequence
GYTG

SEQ ID NO: 2866 - protein, 4 aa, Unknown
  Description of Unknown: Linker sequence
PMSD

SEQ ID NO: 2867 - protein, 4 aa, Unknown
  Description of Unknown: Linker sequence
SDPE

SEQ ID NO: 2868 - protein, 5 aa, Unknown
  Description of Unknown: Linker sequence
DAPGQ

SEQ ID NO: 2869 - protein, 5 aa, Unknown
  Description of Unknown: Linker sequence
FEQTL

SEQ ID NO: 2870 - protein, 5 aa, Unknown
  Description of Unknown: Linker sequence
GGLSQ

SEQ ID NO: 2871 - protein, 6 aa, Unknown
  Description of Unknown: Linker sequence
AGENEI

SEQ ID NO: 2872 - protein, 6 aa, Unknown
  Description of Unknown: Linker sequence
QRCGFV

SEQ ID NO: 2873 - protein, 6 aa, Unknown
  Description of Unknown: Linker sequence
RQREGT

SEQ ID NO: 2874 - protein, 7 aa, Unknown
  Description of Unknown: Linker sequence
HGNNPLA

SEQ ID NO: 2875 - protein, 8 aa, Unknown
  Description of Unknown: Linker sequence
GAHYRTSP

SEQ ID NO: 2876 - protein, 8 aa, Unknown
  Description of Unknown: Linker sequence
QYTQDLDY

SEQ ID NO: 2877 - protein, 11 aa, Unknown
  Description of Unknown: Linker sequence
WAGFRRPRGNL

SEQ ID NO: 2878 - protein, 13 aa, Unknown
  Description of Unknown: Linker sequence
MGNHREASSGCYT

SEQ ID NO: 2879 - protein, 17 aa, Unknown
  Description of Unknown: Linker sequence
LVFDDENFTHTPQGNIV

SEQ ID NO: 2880 - protein, 6 aa, Unknown
  Description of Unknown: Linker sequence
ALPGFQ

SEQ ID NO: 2881 - protein, 14 aa, Unknown
  Description of Unknown: Linker sequence
RASSVAERHVSPDT

SEQ ID NO: 2882 - protein, 7 aa, Unknown
  Description of Unknown: Linker sequence
KISSGDW

SEQ ID NO: 2883 - protein, 7 aa, Unknown
  Description of Unknown: Linker sequence
SKSKNPI

SEQ ID NO: 2884 - protein, 11 aa, Unknown
  Description of Unknown: Linker sequence
FMNKDGCAGFT

SEQ ID NO: 2885 - protein, 4 aa, Unknown
  Description of Unknown: Linker sequence
IMGS

SEQ ID NO: 2886 - protein, 4 aa, Unknown
  Description of Unknown: Linker sequence
KPYK

SEQ ID NO: 2887 - protein, 5 aa, Unknown
  Description of Unknown: Linker sequence
EGPPM

SEQ ID NO: 2888 - protein, 5 aa, Unknown
  Description of Unknown: Linker sequence
LGAEI

SEQ ID NO: 2889 - protein, 5 aa, Unknown
  Description of Unknown: Linker sequence
YIPEK

SEQ ID NO: 2890 - protein, 6 aa, Unknown
  Description of Unknown: Linker sequence
GEKLNI

SEQ ID NO: 2891 - protein, 6 aa, Unknown
  Description of Unknown: Linker sequence
NKGYHI

SEQ ID NO: 2892 - protein, 7 aa, Unknown
  Description of Unknown: Linker sequence
CIETGEI

SEQ ID NO: 2893 - protein, 11 aa, Unknown
  Description of Unknown: Linker sequence
TGNPLLWSDDL

SEQ ID NO: 2894 - protein, 8 aa, Unknown
  Description of Unknown: Linker sequence
KHEYQDRF

SEQ ID NO: 2895 - protein, 9 aa, Unknown
  Description of Unknown: Linker sequence
CRFGYRDSI

SEQ ID NO: 2896 - protein, 9 aa, Unknown
  Description of Unknown: Linker sequence
RLDPTTVTP

SEQ ID NO: 2897 - protein, 11 aa, Unknown
  Description of Unknown: Linker sequence
PKEWQPVLTYG

SEQ ID NO: 2898 - protein, 19 aa, Unknown
  Description of Unknown: Linker sequence
CNTTKCNEGPILELENLPQ

SEQ ID NO: 2899 - protein, 24 aa, Unknown
  Description of Unknown: Linker sequence
CGLDLCNQGNSGRAVTYSRSRYLE

SEQ ID NO: 2900 - protein, 7 aa, Unknown
  Description of Unknown: Linker sequence
SFPKDPE

SEQ ID NO: 2901 - protein, 8 aa, Unknown
  Description of Unknown: Linker sequence
VRTEIAKK

SEQ ID NO: 2902 - protein, 14 aa, Unknown
  Description of Unknown: Linker sequence
IIRKDQRLKFGEGI

SEQ ID NO: 2903 - protein, 11 aa, Unknown
  Description of Unknown: Linker sequence
EQLLGTSFLTR

SEQ ID NO: 2904 - protein, 25 aa, Unknown
  Description of Unknown: Linker sequence
PHDQCACGVLTSEKRAPDLQDLPWQ

SEQ ID NO: 2905 - protein, 8 aa, Unknown
  Description of Unknown: Linker sequence
KVSGENHV

SEQ ID NO: 2906 - protein, 6 aa, Unknown
  Description of Unknown: Linker sequence
NVAEDY

SEQ ID NO: 2907 - protein, 4 aa, Unknown
  Description of Unknown: Linker sequence
IDWR

SEQ ID NO: 2908 - protein, 4 aa, Unknown
  Description of Unknown: Linker sequence
RKGS

SEQ ID NO: 2909 - protein, 5 aa, Unknown
  Description of Unknown: Linker sequence
LFKSP

SEQ ID NO: 2910 - protein, 8 aa, Unknown
  Description of Unknown: Linker sequence
QNLTAPAT

SEQ ID NO: 2911 - protein, 6 aa, Unknown
  Description of Unknown: Linker sequence
YAPRPR

SEQ ID NO: 2912 - protein, 7 aa, Unknown
  Description of Unknown: Linker sequence
YGPDGQR

SEQ ID NO: 2913 - protein, 9 aa, Unknown
  Description of Unknown: Linker sequence
VSQKTFPQL

SEQ ID NO: 2914 - protein, 17 aa, Unknown
  Description of Unknown: Linker sequence
GVSDDDAFEVGLTCGGI

SEQ ID NO: 2915 - protein, 4 aa, Unknown
  Description of Unknown: Linker sequence
FNDK

SEQ ID NO: 2916 - protein, 4 aa, Unknown
  Description of Unknown: Linker sequence
HDRN

SEQ ID NO: 2917 - protein, 5 aa, Unknown
  Description of Unknown: Linker sequence
KVKAD

SEQ ID NO: 2918 - protein, 6 aa, Unknown
  Description of Unknown: Linker sequence
EAGISS

SEQ ID NO: 2919 - protein, 6 aa, Unknown
  Description of Unknown: Linker sequence
IKASWA

SEQ ID NO: 2920 - protein, 6 aa, Unknown
  Description of Unknown: Linker sequence
LTRGFA

SEQ ID NO: 2921 - protein, 7 aa, Unknown
  Description of Unknown: Linker sequence
LNGRARA

SEQ ID NO: 2922 - protein, 7 aa, Unknown
  Description of Unknown: Linker sequence
SLATFDS

SEQ ID NO: 2923 - protein, 8 aa, Unknown
  Description of Unknown: Linker sequence
ALPEGHAK

SEQ ID NO: 2924 - protein, 8 aa, Unknown
  Description of Unknown: Linker sequence
ATTGVEGL

SEQ ID NO: 2925 - protein, 8 aa, Unknown
  Description of Unknown: Linker sequence
RPKSTEKL

SEQ ID NO: 2926 - protein, 9 aa, Unknown
  Description of Unknown: Linker sequence
YTSRKKTHE

SEQ ID NO: 2927 - protein, 10 aa, Unknown
  Description of Unknown: Linker sequence
ASPYHLGIND

SEQ ID NO: 2928 - protein, 10 aa, Unknown
  Description of Unknown: Linker sequence
GLQDWNVTPE

SEQ ID NO: 2929 - protein, 10 aa, Unknown
  Description of Unknown: Linker sequence
LDRKSGDYNQ

SEQ ID NO: 2930 - protein, 13 aa, Unknown
  Description of Unknown: Linker sequence
LLDRDLNLNLPPV

SEQ ID NO: 2931 - protein, 13 aa, Unknown
  Description of Unknown: Linker sequence
SEGLLPLDNHYHF

SEQ ID NO: 2932 - protein, 14 aa, Unknown
  Description of Unknown: Linker sequence
ESPVDSEQRGENDL

SEQ ID NO: 2933 - protein, 15 aa, Unknown
  Description of Unknown: Linker sequence
ALHDMNVELEEKTSH

SEQ ID NO: 2934 - protein, 15 aa, Unknown
  Description of Unknown: Linker sequence
VDKAPYRFTHGWTYS

SEQ ID NO: 2935 - protein, 16 aa, Unknown
  Description of Unknown: Linker sequence
HRGAHIYMNSWQSIDF

SEQ ID NO: 2936 - protein, 17 aa, Unknown
  Description of Unknown: Linker sequence
RENGLVRSPGGFPGEDL

SEQ ID NO: 2937 - protein, 18 aa, Unknown
  Description of Unknown: Linker sequence
VAGVGTRSSDGFQTSGDY

SEQ ID NO: 2938 - protein, 21 aa, Unknown
  Description of Unknown: Linker sequence
EIHVEQKLPQKLSAKAKELPI

SEQ ID NO: 2939 - protein, 6 aa, Unknown
  Description of Unknown: Linker sequence
RWQSFN

SEQ ID NO: 2940 - protein, 9 aa, Unknown
  Description of Unknown: Linker sequence
SLTARPGFL

SEQ ID NO: 2941 - protein, 10 aa, Unknown
  Description of Unknown: Linker sequence
LRIPFSEHLG

SEQ ID NO: 2942 - protein, 10 aa, Unknown
  Description of Unknown: Linker sequence
VVGGQQGSLE

SEQ ID NO: 2943 - protein, 13 aa, Unknown
  Description of Unknown: Linker sequence
DDFDKDTLNINFQ

SEQ ID NO: 2944 - protein, 13 aa, Unknown
  Description of Unknown: Linker sequence
YGRESLQSKFTQA

SEQ ID NO: 2945 - protein, 18 aa, Unknown
  Description of Unknown: Linker sequence
VEAPDLPQQEWAPTYEER

SEQ ID NO: 2946 - protein, 31 aa, Unknown
  Description of Unknown: Linker sequence
IGCPGDTQGDTYLSKGDKRVNEDAVRGLKAE

SEQ ID NO: 2947 - protein, 20 aa, Unknown
  Description of Unknown: Linker sequence
FQGYYLVSPSETFLERDVLK

SEQ ID NO: 2948 - protein, 135 aa, Artificial Sequence
  Description of Artificial Sequence: Synthetic polypeptide
QLQLVESGGGLVQPGGSLRLSCEASGFTLDYYGIGWFRQPPGKEREAVSYISASARTILYADSVKGRFTISRDNAKNAVYLQMNSLKREDTAVYYCARRRFSASSVNRWLADDYDVWGRGTQVAVSSEPKTPKPQ

SEQ ID NO: 2949 - protein, 119 aa, Artificial Sequence
  Description of Artificial Sequence: Synthetic polypeptide
QVQLVESGGGLVQTGGSLRLSCASSGSIAGFETVTWSRQAPGKSLQWVASMTKTNNEIYSDSVKGRFIISRDNAKNTVYLQMNSLKPEDTGVYFCKGPELRGQGIQVTVSSEPKTPKPQ

SEQ ID NO: 2950 - protein, 129 aa, Artificial Sequence
  Description of Artificial Sequence: Synthetic polypeptide
QVQLVESGGGLVQPGGSLRLSCAASGFTFSDYVMTWVRQAPGKGPEWIATINTDGSTMRDDSTKGRFTISRDNAKNTLYLQMTSLKPEDTALYYCARGRVISASAIRGAVRGPGTQVTVSSEPKTPKPQ

SEQ ID NO: 2951 - protein, 675 aa, Artificial Sequence
  Description of Artificial Sequence: Synthetic polypeptide
METDTLLLWVLLLWVPGSTGDAAQPARRARRTKLSGAPVPYPDPLEPRAAAQVQLVESGGGLVQPGGSLRLSCAASGFTLDYSSIGWFRQAPGKEREGVSCISSSGDSTKYADSVKGRFTTSRDNAKNTVYLQMNSLKPDDTAVYYCAAFRATMCGVFPLSPYGKDDWGKGTLVTVSSEPKTPKPQPTSAIAGGGGSGGGGSGGGGSAAAQLQLVESGGGLVQPGGSLRLSCEASGFTLDYYGIGWFRQPPGKEREAVSYISASARTILYADSVKGRFTISRDNAKNAVYLQMNSLKREDTAVYYCARRRFSASSVNRWLADDYDVWGRGTQVAVSSEPKTPKPQTSALVGGGGSGGGGSGGGGSLQAMAAAQVQLVESGGGLVQTGGSLRLSCASSGSIAGFETVTWSRQAPGKSLQWVASMTKTNNEIYSDSVKGRFIISRDNAKNTVYLQMNSLKPEDTGVYFCKGPELRGQGIQVTVSSEPKTPKPQAIAGGGGSGGGGSGGGGSLQGQVQLVESGGGLVQPGGSLRLSCAASGFTFSDYVMTWVRQAPGKGPEWIATINTDGSTMRDDSTKGRFTISRDNAKNTLYLQMTSLKPEDTALYYCARGRVISASAIRGAVRGPGTQVTVSSEPKTPKPQPARQGAPVPYPDPLEPRGGGSDICLPRWGCLWED

SEQ ID NO: 2952 - protein, 117 aa, Artificial Sequence
  Description of Artificial Sequence: Synthetic polypeptide
QVQLVQSGAEVKKPGASVKVSCKASGYTFNDHNIHWVRQAPGQGLEWIGYIYPYIGTTVYNQKFKSKATLTVDTSTSTAYMELRSLRSDDTAVYYCSRWGHRGFPYWGQGTLVTVSS

SEQ ID NO: 2953 - protein, 117 aa, Artificial Sequence
  Description of Artificial Sequence: Synthetic polypeptide
QVQLVQSGAEVKKPGASVKVSCKASGYTFNDHNIHWVRQAPGQGLEWIGYIYPYIGTTVYNQKFKSKATLTVDNSTSTAYMELRSLRSDDTAVYYCSRWGHRGFPYWGQGTLVTVSS

SEQ ID NO: 2954 - protein, 118 aa, Artificial Sequence
  Description of Artificial Sequence: Synthetic polypeptide
QVQLVQSGAEVKKPGASVKVSCKASGYTFTDYNMDWVRQAPGQRLEWIGDINPKYDIIGHNPKFMGKATLTVDKSASTAYMELSSLRSEDTAVYYCARSDRGWYFDVWGQGTLVTVSS

SEQ ID NO: 2955 - protein, 118 aa, Artificial Sequence
  Description of Artificial Sequence: Synthetic polypeptide
QVQLVQSGAEVKKPGASVKVSCKASGYTFTDYNMDWVRQAPGQRLEWIGDINPKYDIIGHNPKFMGKATITVDKSASTAYMELSSLRSEDTAVYYCARSDRGWYFDVWGQGTLVTVSS

SEQ ID NO: 2956 - protein, 117 aa, Artificial Sequence; identical to SEQ ID NO: 2952
  Description of Artificial Sequence: Synthetic polypeptide

SEQ ID NO: 2957 - protein, 117 aa, Artificial Sequence; identical to SEQ ID NO: 2953
  Description of Artificial Sequence: Synthetic polypeptide

SEQ ID NO: 2958 - protein, 118 aa, Artificial Sequence; identical to SEQ ID NO: 2954
  Description of Artificial Sequence: Synthetic polypeptide

SEQ ID NO: 2959 - protein, 118 aa, Artificial Sequence; identical to SEQ ID NO: 2955
  Description of Artificial Sequence: Synthetic polypeptide

SEQ ID NO: 2960 - protein, 119 aa, Artificial Sequence
  Description of Artificial Sequence: Synthetic polypeptide
QIQLVESGGGVVQPGRSLRLSCVASGFTLSGHGMHWVRQAPGKGLEWVAFISFDGGHQDYTDAAEGRFTISRDNSKNTLYLEMVSLRPADTAIYYCVKGSDSSRGFGYWGRGILVTVSS

SEQ ID NO: 2961 - protein, 119 aa, Artificial Sequence
  Description of Artificial Sequence: Synthetic polypeptide
QVQLVESGGDVVQPGRSLRLSCAASGFTFSGHGMHWVRQAPGKGLEWVALILYDGSSEDYTDSVKGRFTVSRDNSKNTLYLQMNSLRAEDTAVYYCARGSILNRPFDYWGQGTLVTVSS

SEQ ID NO: 2962 - protein, 119 aa, Artificial Sequence
  Description of Artificial Sequence: Synthetic polypeptide
EVQLLESGGGLAQPGGSLRLSCAASGFNFGTHDMSWVRQAPGKGLEWVSGLTSTGGSASSADSVKGRFTISRDNSKNILYLQMNSLRAEDTAVYYCAKTFNWNSYFDYWGQGTLVTVSS

SEQ ID NO: 2963 - protein, 124 aa, Artificial Sequence
  Description of Artificial Sequence: Synthetic polypeptide
DVQLVESGGDFVQPGGSLRLSCAASGVAFNDYEMNWIRQAPGKRLEWISHIDSSGTIIYYADSVKGRFTISRDSAKNSLFLQMDSLRAEDTAVYYCARERYSHYGYYYFGMDVWGQGTTVTVSS

SEQ ID NO: 2964 - protein, 124 aa, Artificial Sequence
  Description of Artificial Sequence: Synthetic polypeptide
EVQLVESGGDLVQPGGSLRLSCAASGVTFRTYEMNWVRQAPGKGLEWISHISSSGDIIYYTKSVKGRFTISRDNAKNSLFLQMTSLRAEDTAVYYCARERYSQYGYYYFGMDVWGQGTTVTVSS

SEQ ID NO: 2965 - protein, 124 aa, Artificial Sequence
  Description of Artificial Sequence: Synthetic polypeptide
EIQLIESGGDMVQPGGSLRLSCAASGISLNSYEMNWVRQTPGMGLEWISHISSSGTSIYYANSVKGRFTIFRDSAKNSLLLQMNSLRAEDTAIYYCARERYDHSGYYYLGMDVWGLGTTVTVSS

SEQ ID NO: 2966 - protein, 124 aa, Artificial Sequence
  Description of Artificial Sequence: Synthetic polypeptide
EVQLVESGGGLVQPGGSLTLSCAASRFTFSNYDMHWVRQATGKGLEWVSAIGTVGDTYYAGSVKGRFTISRDDAKNSLYLQMNSLRAGDTAVYYCARDRGGAGTYSFYYGMDVWGQGTTVTVSS

SEQ ID NO: 2967 - protein, 124 aa, Artificial Sequence
  Description of Artificial Sequence: Synthetic polypeptide
EVQLVESGGGLVQPGGSLRLSCAASGFTFSSYDMHWVRQVIGKGLEWVSAIGTVGDTYYAGSVKGRFTISRENAKNSLYLQMNSLRAGDTAVYYCARDRGGANIYSFYYGMDVWGQGTTVTVSS

SEQ ID NO: 2968 - protein, 131 aa, Artificial Sequence
  Description of Artificial Sequence: Synthetic polypeptide
EVQLVESGGGLVQPGGSLRLSCAASGFTFNSFVMSWVRQAPGKGLEWVSAISGYGGSTYYADSMKGRFTVSRDNSKNTLYLQMNSLRAEDTAVYYCAKDHKDFYASGSYFNRDYYYGMDVWGQGTTVTVSS

SEQ ID NO: 2969 - protein, 123 aa, Artificial Sequence
  Description of Artificial Sequence: Synthetic polypeptide
QVQLVESGGGVVQPGGSLRLSCAASGFTFSSYAMHWVRQAPGKGLEWVAIIWFDGSNEDYADSVKGRFTISRDNSKNMVYLQINSLRAEDTAVYYCARSANWNYEGGPLFDYWGQGTLVTVSS

SEQ ID NO: 2970 - protein, 116 aa, Artificial Sequence
  Description of Artificial Sequence: Synthetic polypeptide
QVQLVESGGGLVKPGGSLTLSCVASGFTFTDYYISWIRQAPGKGLEWISYIGTGGAAKYYADSVKGRFTVSRDNAKNSLYLLMNNLRAEDTAVYYCARDLGIFDLWGQGTLVTVSS

SEQ ID NO: 2971 - protein, 116 aa, Artificial Sequence
  Description of Artificial Sequence: Synthetic polypeptide
EVQLVESGGGLVQPGGSLRLSCVASGFTFTSYAMSWVRQAPGRGLQWVSAIGGSGDSIYYADSVKGRFTISRDNSKNTLYLQMDSLRAEDTAVYYCARGWELLNYWGQGTLVTVSS

SEQ ID NO: 2972 - protein, 116 aa, Artificial Sequence
  Description of Artificial Sequence: Synthetic polypeptide
EVQLVESGGGLVRPGGSLRLSCAASGFTFRIYAMSWVRQAPGKGLEWVSGISGSGDNTYYTDSVKGRFIISRDNSKSTLYLQMNSLRAEDTAVYYCARGWELLNYWGQGTLVTVSS

SEQ ID NO: 2973 - protein, 116 aa, Artificial Sequence
  Description of Artificial Sequence: Synthetic polypeptide
EVQLVESGGGLVQPGGSLRLSCAASGFTFKIYAMSWVRQGPGKGLEWVSAISGNGDKTYYTDSVQGRFTISRDNSKNTLFLQMNSLRAEDTAIYYCARGWELLNYWGQGTLVTVSS

SEQ ID NO: 2974 - protein, 116 aa, Artificial Sequence
  Description of Artificial Sequence: Synthetic polypeptide
EVQLVESGGGLVQPGGSLRLSCAVSGFTFSIYAMSWVRQAPGKGLEWVSAISGSGDKTYYADSVKGRFTISRDNSKNTLYLQMNSLRAEDTAVFYCARGWELLNYWGQGTLVTVSS

SEQ ID NO: 2975 - protein, 116 aa, Artificial Sequence
  Description of Artificial Sequence: Synthetic polypeptide
EVQLVESGGGLVQPGGSLRLSCAASGFTFSIYAMSWVRQAPGKGLEWVSGISGSGGRTYYADSVKGRFTISRDNSKNTLYLQMNSLRVEDTAVYYCARGWELLNFWGQGTLVTVSS

SEQ ID NO: 2976 - protein, 116 aa, Artificial Sequence
  Description of Artificial Sequence: Synthetic polypeptide
EVQLVESGGGLVQPGGSLRLSCVASGFNFRIYAMSWVRQAPGKGPEWVSGISGSGDNTYYAASVKGRFTVSRDNSKNTLYLQMTSLRAEDTAVFYCARGWELLNYWGQGTLVTVSS

SEQ ID NO: 2977 - protein, 117 aa, Artificial Sequence
  Description of Artificial Sequence: Synthetic polypeptide
EVQLVESGGGLVQPGGSLRLSCAASGFTFSRYGMNWVRQAPGKGLEWVSAISGSGGSTYHADSVKGRFTISRDNSKNTLYLQMNSLRAADTAIYFCASYNWNDGVDVWGQGTTVTVS

SEQ ID NO: 2978 - protein, 120 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYHDYAFSVKSRILINPDTSKNLFSLQVNSVTPEDTAVYYCARDRRSYFDYWGQGTLVTVSS

SEQ ID NO: 2979 - protein, 121 aa, Artificial Sequence
  Description of Artificial Sequence: Synthetic polypeptide
QVQLVESGGGVVQPGRSLRLSCAASGFTFSSFGMHWVRQAPGKGLEWVSMISTDGSKKNYADSVKGRFTITRDNSKNTLYLEMNSLRAEDTAVYYGVRVGYYDSGSYYNYWGQGTLVTVSS

SEQ ID NO: 2980 - protein, 123 aa, Artificial Sequence
  Description of Artificial Sequence: Synthetic polypeptide
EVQLVESGGGLVQPGRSLRLSCTASGFVFEDYAMHWVRQAPGKGLEWVSGISWNSGRIGYTDSVKGRFTVSRDNAKNSLYLQMNSLTTEDTALYYCAKDKSPSKWNLLGMDVWGQGTTVTVSS

SEQ ID NO: 2981 - protein, 121 aa, Artificial Sequence
  Description of Artificial Sequence: Synthetic polypeptide
QVQLVQSGAEVQKPGASVKVSCKASGYTFTDYYIHWVRQAPGQGLEWMGWINPKTGGTNYAPKFQGRVTMTRDSSIITAYMDLTRLTSDDTAVFYCARRGYNSRWSVFDYWGQGTLVTVSS

SEQ ID NO: 2982 - protein, 122 aa, Artificial Sequence
  Description of Artificial Sequence: Synthetic polypeptide
QVQLVESGGGVVQPGRSLRLSCEASGFTFSSYGMHWVRQAPGNGLEWIAVISSDGNNKYYIESVKGRFTMSRDNSKNTLYLQLNSLRTEDTAVYYCATYNWNDDGDGVFDYWGQGTLVTVSS

SEQ ID NO: 2983 - protein, 119 aa, Artificial Sequence
  Description of Artificial Sequence: Synthetic polypeptide
QVQLVQSGAEVKKPGASVKVSCKASGYPFTNYFMHWVRQAPGQRLEWIGRINPYNGATSYSLNFRDKATLTLDKSASTAYMELSSLRSEDTAVYYCARSTITSPLLDFWGQGTLVTVSS

SEQ ID NO: 2984 - protein, 119 aa, Artificial Sequence
  Description of Artificial Sequence: Synthetic polypeptide
QVQLVQSGAEVKKPGASVKVSCKASGYPFTNYFMHWVRQAPGQRLEWIGRINPYNGATSYSLNFRDKATITLDKSASTAYMELSSLRSEDTAVYYCARSTITSPLLDFWGQGTLVTVSS

SEQ ID NO: 2985 - protein, 119 aa, Artificial Sequence; identical to SEQ ID NO: 2983
  Description of Artificial Sequence: Synthetic polypeptide

SEQ ID NO: 2986 - protein, 119 aa, Artificial Sequence; identical to SEQ ID NO: 2984
  Description of Artificial Sequence: Synthetic polypeptide

SEQ ID NO: 2987 - protein, 122 aa, Artificial Sequence
  Description of Artificial Sequence: Synthetic polypeptide
QVQLVESGGGVVQPGRSLRLSCAASGFSFSNYGMHWVRQAPGKGLEWVALIWYDGSNEDYTDSVKGRFTISRDNSKNTLYLQMNSLRAEDTAVYYCARWGMVRGVIDVFDIWGQGTVVTVSS

SEQ ID NO: 2988 - protein, 114 aa, Artificial Sequence
  Description of Artificial Sequence: Synthetic polypeptide
QMQLVESGGGVVQPGRSLRLSCEASGFSFNSYGMHWVRQAPGKGLEWVSVIWASGNKKYYIESVEGRFTISRDNSKNTLYLQMNSLRAEDTAVYYCARANFDYWGQGTLVTVSS

SEQ ID NO: 2989 - protein, 116 aa, Artificial Sequence
  Description of Artificial Sequence: Synthetic polypeptide
QVQLVESGGGVVQPGRSLRLSCAASGFTFNKYGMHWVRQAPGKGLEWVAVIWYDGTNKYYADSMKGRFTISRDNSKNMLYLQMNSLRAEDTAVYYCARDPPTANYWGQGTLVTVSS

SEQ ID NO: 2990 - protein, 118 aa, Artificial Sequence
  Description of Artificial Sequence: Synthetic polypeptide
QVQLVQSGSELKKPGASVKVSCKASGYTFTNQGMNWVRQAPGQGLEWMGWINTNTGEPTYAQGFTGRFVFSLDTSVSTAYLQISSLKAEDTAVYYCYVNYDYYTMDFWGQGTTVTVSS

SEQ ID NO: 2991 - protein, 118 aa, Artificial Sequence
  Description of Artificial Sequence: Synthetic polypeptide
QIQLVQSGPELKKPGETVKISCKASGYTFTNQGMNWVKQAPGKGLKWMGWINTNTGEPTYTADFTGRFAFSLETSVSTAYLQINSLKAEDTATYFCYVNYDYYTMDFWGQGTLVTVSS

SEQ ID NO: 2992 - protein, 135 aa, Artificial Sequence
  Description of Artificial Sequence: Synthetic polypeptide
QVQLVESGGGLVQPGGSLRLSCAASGFSLDYYGIGWFRQAPGKERQEVSYISASAKTKLYSDSVKGRFTISRDNAKNAVYLEMNSLKREDTAVYYCARRRFDASASNRWLAADYDYWGQGTQVTVSSEPKTPKPQ

SEQ ID NO: 2993 - protein, 437 aa, Artificial Sequence
  Description of Artificial Sequence: Synthetic polypeptide
EVQLVQSGAEVKKSGESLKISCKGSGYSFTSYWIGWVRQMPGKGLEWMGIFYPGDSSTRYSPSFQGQVTISADKSVNTAYLQWSSLKASDTAMYYCARRRNWGNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNH

SEQ ID NO: 2994 - protein, 135 aa, Artificial Sequence
  Description of Artificial Sequence: Synthetic polypeptide
QVQLVETGGLVQPGGSLRLSCAASGFTLDYSSIGWFRQAPGKEREGVSCISSSGDSTKYADSVKGRFTTSRDNAKNTVYLQMNSLKPDDTAVYYCAAFRATMCGVFPLSPYGKDDWGKGTLVTVSSEPKTPKPQP

SEQ ID NO: 2995 - protein, 130 aa, Artificial Sequence
  Description of Artificial Sequence: Synthetic polypeptide
QLQLVETGGGLVQPGGSLRLSCAASGFTFSDYVMTWVRQAPGKGPEWIATINTDGSTMRDDSTKGRFTISRDNAKNTLYLQMTSLKPEDTALYYCARGRVISASAIRGAVRGPGTQVTVSSEPKTPKPQP

SEQ ID NO: 2996 - protein, 137 aa, Artificial Sequence
  Description of Artificial Sequence: Synthetic polypeptide
QVQLVESGGGLVQPGGSLRLSCAASGFTLDYYAIGWERQAPGKEREGVSGISSVDGSTYYADSVRGRFTISRDNAKNTVYLQMNSLKPEDTAVYYCAADQSPIPIHYSRTYSGPYGMDYWGKGTLVTVSSAHHSEDP

SEQ ID NO: 2997 - protein, 139 aa, Artificial Sequence
  Description of Artificial Sequence: Synthetic polypeptide
QLQLVESGGGLVQPGGSLRLSCAASGFTLDYYAIGWFRQAPGKEREGVSGISFVDGSTYYADSVKGRFAISRGNAKNTVYLQMNSLKPEDTAVYYCAADQSSIPMHYSSTYSGPSGMDYWGKGTLVTVSSEPKTPKPQP

SEQ ID NO: 2998 - protein, 136 aa, Artificial Sequence
  Description of Artificial Sequence: Synthetic polypeptide
QLQLVETGGGLVQAGGSLRLSCAASGRTLSNYPMGWERQAPGKEREEVAAIRRIADGTYYADSVKGRFTISRDNAWNTLYLQMNGLKPEDTAVYFCATGPGAFPGMVVTNPSAYPYWGQGTQVTVSSEPKTPKPQP

SEQ ID NO: 2999 - protein, 139 aa, Artificial Sequence
  Description of Artificial Sequence: Synthetic polypeptide
QLQLVESGGGLVQPGGSLRLSCAASGFTLDYYAIGWFRQAPGKEREGVSGISSSDGSTYYADSVKGRFTISRDNATNTVYLQMNSLKPEDTAVYYCAADQAAIPMHYSASYSGPRGMDYWGKGTLVTVSSEPKTPKPQP

SEQ ID NO: 3000 - protein, 453 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAISDPNSQVQLVESGGGLVQPGGSLRLSCEASGFTLDYYGIGWFRQPPGKEREAVSYISASARTILYADSVKGRFTISRDNAKNAVYLQMNSLKREDTAVYYCARRRFSASSVNRWLADDYDVWGRGTQVAVSSEPKTPKPQTSAIAGGGGSGGGGSGGGGSLQAMAAASQVQLVESGGGLVQTGGSLRLSCASSGSIAGFETVTWSRQAPGKSLQWVASMTKTNNEIYSDSVKGRFIISRDNAKNTVYLQMNSLKPEDTGVYFCKGPELRGQGIQVTVSSEPKTPKPQPARR

SEQ ID NO: 3001 - protein, 505 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAISDPNSQVQLVETGGLVQPGGSLRLSCAASGFTLDYSSIGWFRQAPGKEREGVSCISSSGDSTKYADSVKGRFTTSRDNAKNTVYLQMNSLKPDDTAVYYCAAFRATMCGVFPLSPYGKDDWGKGTLVTVSSEPKTPKPQPTSAIAGGGGSGGGGSGGGGSLQAMAAAQLQLVETGGGLVQPGGSLRLSCAASGFTFSDYVMTWVRQAPGKGPEWIATINTDGSTMRDDSTKGRFTISRDNAKNTLYLQMTSLKPEDTALYYCARGRVISASAIRGAVRGPGTQVTVSSEPKTPKPQPARQTSPSTVRLESRVRELEDRLEELRDELERAERRANEMSIQLDEC

SEQ ID NO: 3002 - protein, 119 aa, Artificial Sequence
  Description of Artificial Sequence: Synthetic polypeptide
EVQLVQSGAEVKKSGESLKISCKGSGYSFTSYWIGWVRQMPGKGLEWMGIFYPGDSSTRYSPSFQGQVTISADKSVNTAYLQWSSLKASDTAMYYCARRRNWGNAFDIWGQGTMVTVSS

SEQ ID NO: 3003 - protein, 123 aa, Artificial Sequence
  Description of Artificial Sequence: Synthetic polypeptide
QVQLVESGGGLVQAGGSLRLSCVSSERNPGINAMGWYRQAPGSQRELVAIWQTGGSLNYADSVKGRFTISRDNLKNTVYLQMNSLKPEDTAVYYCYLKKWRDQYWGQGTQVTVSSEPKTPKPQ

SEQ ID NO: 3004 - protein, 135 aa, Artificial Sequence
  Description of Artificial Sequence: Synthetic polypeptide
QVQLVESGGGLVQPGGSLRLSCEASGFTLDYYGIGWFRQPPGKEREAVSYISASARTILYADSVKGRFTISRDNAKNAVYLQMNSLKREDTAVYYCARRRFSASSVNRWLADDYDVWGRGTQVAVSSEPKTPKPQ

SEQ ID NO: 3005 - protein, 119 aa, Artificial Sequence; identical to SEQ ID NO: 2949
  Description of Artificial Sequence: Synthetic polypeptide

SEQ ID NO: 3006 - protein, 124 aa, Artificial Sequence
  Description of Artificial Sequence: Synthetic polypeptide
QVQLVESGGGLVEAGGSLRLSCVVTGSSFSTSTMAWYRQPPGKQREWVASFTSGGAIKYTDSVKGRFTMSRDNAKKMTYLQMENLKPEDTAVYYCALHNAVSGSSWGRGTQVTVSSEPKTPKPQ

SEQ ID NO: 3007 - protein, 123 aa, Artificial Sequence
  Description of Artificial Sequence: Synthetic polypeptide
VQLVESGGGLVQAGGSLRLSCAASGLMFGAMTMGWYRQAPGKEREMVAYITAGGTESYSESVKGRFTISRINANNMVYLQMTNLKVEDTAVYYCNAHNFWRTSRNWGQGTQVTVSSEPKTPKP

SEQ ID NO: 3008 - protein, 131 aa, Artificial Sequence
  Description of Artificial Sequence: Synthetic polypeptide
VQLVESGGGLVQAGDSLTLSCAASESTFNTFSMAWFRQAPGKEREYVAAFSRSGGTTNYADSVKGRATISTDNAKNTVYLHMNSLKPEDTAVYFCAADRPAGRAYFQSRSYNYWGQGTQVTVSSAHHSEDP

SEQ ID NO: 3009 - protein, 125 aa, Artificial Sequence
  Description of Artificial Sequence: Synthetic polypeptide
VQLVESGGGSVQIGGSLRLSCVASGFTFSKNIMSWARQAPGKGLEWVSTISIGGAATSYADSVKGRFTISRDNANDTLYLQMNNLKPEDTAVYYCSRGPRTYINTASRGQGTQVTVSSEPKTPKP

SEQ ID NO: 3010 - protein, 121 aa, Artificial Sequence
  Description of Artificial Sequence: Synthetic polypeptide
VQLVESGGGLVQAGGSLRLSCVGSGRNPGINAMGWYRQAPGSQRELVAVWQTGGSTNYADSVKGRFTISRDNLKNTVYLQMNSLKPEDTAVYYCYLKKWRDEYWGQGTQVTVSSAHHSEDP

SEQ ID NO: 3011 - protein, 124 aa, Artificial Sequence
  Description of Artificial Sequence: Synthetic polypeptide
VQLVESGGGLVQAGESLRLSCVVSESIFRINTMGWYRQTPGKQREVVARITLRNSTTYADSVKGRFTISRDDAKNTLYLKMDSLKPEDTAVYYCHRYPLIFRNSPYWGQGTQVTVSSEPKTPKP

SEQ ID NO: 3012 - protein, 122 aa, Artificial Sequence
  Description of Artificial Sequence: Synthetic polypeptide
VQLVESGGGLVQAGESLRLSCVVSESIFRINTMGWYRQTPGKQREVVARITLRNSTTYADSVKGRFTISRDDAKNTLYLKMDSLKPEDTAVYYCHRYPLIFRNSPYWGQGTQVTVSSEPKTP

SEQ ID NO: 3013 - protein, 129 aa, Artificial Sequence
  Description of Artificial Sequence: Synthetic polypeptide
VQLVESGGGLVQAGGSLRLSCAAPGLTFTSYRMGWFRQAPGKEREYVAAITGAGATNYADSAKGRFTISKNNTASTVHLQMNSLKPEDTAVYYCAASNRAGGYWRASQYDYWGQGTQVTVSSAHHSEDP

SEQ ID NO: 3014 - protein, 107 aa, Artificial Sequence
  Description of Artificial Sequence: Synthetic polypeptide
DIQMTQSPSSLSASVGDRVTITCKASQNVGTNVAWYQQKPGKAPKALIYSASYRYSGVSSRFSGSGSGTDFTLTISSLQPEDFAVYYCQQYYSYPYTFGQGTKLEIK

SEQ ID NO: 3015 - protein, 107 aa, Artificial Sequence
  Description of Artificial Sequence: Synthetic polypeptide
DIQMTQSPSSLSASVGDRVTITCKASQNVGTNVAWYQQKPGKAPKVLIYSASYRYSGVSSRFSGSGSGTDFTLTISSLQPEDFAVYYCQQYYSYPYTFGQGTKLEIK

SEQ ID NO: 3016 - protein, 104 aa, Artificial Sequence
  Description of Artificial Sequence: Synthetic polypeptide
EIVLTQSPATLSLSPGERATLSCRASSSVNYMNWYQQKPGQAPRPRIYATSNLASGVPARFSGSGSGTDYTLTISSLEPEDFAVYYCQQWSSRTFGGGTKVEIK

SEQ ID NO: 3017 - protein, 107 aa, Artificial Sequence; identical to SEQ ID NO: 3014
  Description of Artificial Sequence: Synthetic polypeptide

SEQ ID NO: 3018 - protein, 107 aa, Artificial Sequence; identical to SEQ ID NO: 3015
  Description of Artificial Sequence: Synthetic polypeptide

SEQ ID NO: 3019 - protein, 104 aa, Artificial Sequence; identical to SEQ ID NO: 3016
  Description of Artificial Sequence: Synthetic polypeptide

SEQ ID NO: 3020 - protein, 113 aa, Artificial Sequence
  Description of Artificial Sequence: Synthetic polypeptide
DIVMTQSPDSLAVSLGERATINCKSSQSVLFSSDNKNYLAWYQLKPGQPPHLLIYWASIRDSGVPDRFSGSGSGTDFTLTISSLQAEDVAVYSCHQYYSAPLTFGGGTKVEIK

SEQ ID NO: 3021 - protein, 113 aa, Artificial Sequence
  Description of Artificial Sequence: Synthetic polypeptide
DIVMTQSPDSLAVSLGERATINCKSSQSILFSSNNKIYLAWFQQKPGQPPKLLIYWTSTRESGVPDRFSGSGSGTDFTLTISSLQAEDVAVYYCQQYYTLPFTFGPGTKVDIK

SEQ ID NO: 3022 - protein, 108 aa, Artificial Sequence
  Description of Artificial Sequence: Synthetic polypeptide
EIVLTQSPGTLSLSPGERATLSCRASQSISTYYLAWYQQKPDQPPRLLIYGTSSRATGIPDRFSGSGSGTDFTLTISRLDPEDFAVYYCQQYGNSLYTFGQGTKLEIK

SEQ ID NO: 3023 - protein, 107 aa, Artificial Sequence
  Description of Artificial Sequence: Synthetic polypeptide
DIQMTQSPSTLSASVGDRVTITCRASQNIDNWLAWYQQKTGKAPNLLIYKASTLESGVPSRFSGSGSGTEFTLTIISLQPDDFATYYCQEYNTYSRTFGQGTKVEIK

SEQ ID NO: 3024 - protein, 107 aa, Artificial Sequence
  Description of Artificial Sequence: Synthetic polypeptide
DIQMTQSPSTLSASIGDRVTITCRASQNTDKWMAWYQQKAGKAPKLLIYKASILESGVPSRFSGSGSGTEFTLTISSLQPDDFATYYCQEYNTYFRAFGQGTKVETR

SEQ ID NO: 3025 - protein, 107 aa, Artificial Sequence
  Description of Artificial Sequence: Synthetic polypeptide
DIQMTQSPSTLSASLGDRVTITCRASQNIDNWMAWYQQKVGKAPKLLIYRASTLETGVPSRFGGSGFGTEFTLTISSLQPGDFATYYCQEYNSYFRTFGQGTKVEIK

SEQ ID NO: 3026 - protein, 108 aa, Artificial Sequence
  Description of Artificial Sequence: Synthetic polypeptide
DIQMTQSPSSLSASVGDRVTITCRASQDISNYLAWYQQKPGKVPKLLIYAASTLQSGVPSRFSGSGSGTDFTLTVSSLQPEDVATYYCQKYTSAPFTFGPGTKVDIKR

SEQ ID NO: 3027 - protein, 108 aa, Artificial Sequence
  Description of Artificial Sequence: Synthetic polypeptide
DIQMTQSPSSLSVSVGDRVTITCRASQDISNYLAWYQQKPGKVPKLLIYAASTLQSGVPSRFSGSGSGTDFTLTISSLQPEDVATYFCQKYNSAPFTFGPGTKVDIKR

SEQ ID NO: 3028 - protein, 108 aa, Artificial Sequence
  Description of Artificial Sequence: Synthetic polypeptide
DIQMTQSPSTLSASVGDRVTITCRASQSISSWLAWYQQKPGKAPKVLIYKASSLESGVPSRFSGSGSGTEFTLTISSLQPDDFATYYCQQYNSYSRTFGQGTKVEIKR

SEQ ID NO: 3029 - protein, 108 aa, Artificial Sequence
  Description of Artificial Sequence: Synthetic polypeptide
DIQMTQSPSSLSASVGDRVTITCRASQTISTFLNWYQQKPGKGPELLIYTASSLQSGVPSRFSGSGSGTDFALTISSLQPEDFATYYCQQNYNDPPTFGQGTRLEIKR

SEQ ID NO: 3030 - protein, 109 aa, Artificial Sequence
  Description of Artificial Sequence: Synthetic polypeptide
EIVMTQSPATLSVSPGERATLSCRASQSVSSSLAWYHQKPGQAPRLLIHGVSTRATGIPARFSGTGSGTEFTLTISSLQSEDFAVYYCQQYHNWPPYTFGQGTKLEIKR

SEQ ID NO: 3031 - protein, 108 aa, Artificial Sequence
  Description of Artificial Sequence: Synthetic polypeptide
DIQMTQSPSSLSASVGDRVTITCRASQDIGNFLAWFQQKPGKAPKSLIYAASSLKSGVPSKISGSGSGTDFTLTINSLQPEDFATYYCQQYNIYPPTFGPGTKVDIKR

SEQ ID NO: 3032 - protein, 108 aa, Artificial Sequence
  Description of Artificial Sequence: Synthetic polypeptide
DIQMTQSPSSLSAFVGDRVTITCRASQDISNHLAWFQQKPGKVPKSLIYAASSLQSGVPSKFSGSGSGTDFTLTISSLQPEDFATYYCQQYGLYPPTFGPGTKVDIKR

SEQ ID NO: 3033 - protein, 108 aa, Artificial Sequence
  Description of Artificial Sequence: Synthetic polypeptide
DIQMTQSPSSLSASIGDRVTITCRASQDISNSLAWFQQKPGKAPKSLIYAASSLQSGVPSRFSGSGSGTDFTLTISSLQPEDFATYYCQQYIPFPPTFGPGTKVDIKR

SEQ ID NO: 3034 - protein, 108 aa, Artificial Sequence
  Description of Artificial Sequence: Synthetic polypeptide
DIQMTQSPSSLSASVGDRVTITCRASLDISNFLAWFQQKPGTAPKSLIYSASSLRTGVPSKFSGSGSGTDFTLTISSLQPEDFATYYCQQYSSYPPTFGPGTKVDIKR

SEQ ID NO: 3035 - protein, 108 aa, Artificial Sequence
  Description of Artificial Sequence: Synthetic polypeptide
DIQMTQSPSSLSASVGDRVTITCRASQGISNNLAWFQQKPGKAPKSLIYAASSLKSGVPSKFSGSGSGTDFTLTINSLQPEDFATYYCHQYNSYPPTFGPGTKVDIKR

SEQ ID NO: 3036 - protein, 146 aa, Artificial Sequence
  Description of Artificial Sequence: Synthetic polypeptide
DIQMTQSPSSLSASVGDRVTITCRASLDISNFLAWFQQDIQMTQSPSSLSASVGDRVTITCRASLDIGNFLAWFQQKPGTAPKSLIYSASSLQTGVPSKFSGSGSGTDFTLTISSLQPEDFATYYCQQYNSYPPTFGPGTKVDIKR

SEQ ID NO: 3037 - protein, 108 aa, Artificial Sequence
  Description of Artificial Sequence: Synthetic polypeptide
DIQMTQSPSSVSASIGDRVTITCRASQGISNWLAWYQQKPGKAPKLLIYGASSLQSGVSSRFSGSGSGTDFTLTIISLQPEDFATYYCQQANSFPYTFGQGTKLEIKR

SEQ ID NO: 3038 - protein, 108 aa, Artificial Sequence
  Description of Artificial Sequence: Synthetic polypeptide
EIVLTQSPATLSLSPGERATLSCRASRSVSSSLAWYQQKPGQAPRLLIYDASNRATGIPARFSGGGSGTDFTLTISSLEPEDFAVYYCQQRNNWPPTFGQGTKLEIKR

SEQ ID NO: 3039 - protein, 108 aa, Artificial Sequence
  Description of Artificial Sequence: Synthetic polypeptide
DIQMTQSPSSVSASVGDRVTITCRASQGIRSWLAWFQQRPGKAPNLLIYAASSLQSGVSSRFSGSGSGTEFTLSISSLQPEDFATYYCQQAYSFPLTFGGGTKVEIKR

SEQ ID NO: 3040 - protein, 108 aa, Artificial Sequence
  Description of Artificial Sequence: Synthetic polypeptide
AIQMTQSPSSLSASVGDRVTITCRASQDIRNDLGWFQQKPGRAPNLLIFGASSLQSGVPSRFSGSGSGTDFTLTISGLQPEDFSTYYCLQDYTYPFTFGPGTKVDIKR

SEQ ID NO: 3041 - protein, 109 aa, Artificial Sequence
  Description of Artificial Sequence: Synthetic polypeptide
EIVLTQSPGTLSLSPGERATLSCRASQSVYSNYLAWYQQKRGLAPRLLIYGASSRATGIPDRFSGSGSGTDFTLTISRLEPEDFAVYYCQQHGGSPVTFGGGTKVEIKR

SEQ ID NO: 3042 - protein, 108 aa, Artificial Sequence
  Description of Artificial Sequence: Synthetic polypeptide
DIQMTQSPSSVSASVGDRVTITCRASQGISNWLAWYQQKPGKAPKLLIYGTSSLQSGVPSRFSGSGSGTDFTLTISSLQPEDFATYYCQQVKSFPYTFGQGTKLEIKR

SEQ ID NO: 3043 - protein, 107 aa, Artificial Sequence
  Description of Artificial Sequence: Synthetic polypeptide
EIVLTQSPATLSLSPGERATLSCRASQSVGTSIHWYQQKPGQAPRLLIKFASESISGIPARFSGSGSGTDFTLTISSLEPEDFAVYYCQQSNKWPFTFGQGTKLEIK

SEQ ID NO: 3044 - protein, 107 aa, Artificial Sequence; identical to SEQ ID NO: 3043
  Description of Artificial Sequence: Synthetic polypeptide

SEQ ID NO: 3045 - protein, 107 aa, Artificial Sequence
  Description of Artificial Sequence: Synthetic polypeptide
DIQMTQSPSSVSASVGDRVTITCRASQGISSWLAWYQHKPGKAPKLLIYAASSLQSGVPSRFSGSGSGTDFTLTISSLQPEDFATYYCQQANSFPWTFGQGTKVEIK

SEQ ID NO: 3046 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWSQFTFGPGTKVDIK

SEQ ID NO: 3047 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYKSYPVTFGGGTKVEIK

SEQ ID NO: 3048 - protein, 108 aa, Artificial Sequence
  Description of Artificial Sequence: Synthetic polypeptide
DIQMTQSPSSLSASVGDRVTITCRASSSVISTYLNWYQQKPGKAPKLLIYSTSSLQSGVPSRFSGSGSGTDFTLTISSLQPEDFATYYCLQYHRSPRTFGGGTKVEIK

SEQ ID NO: 3049 - protein, 108 aa, Artificial Sequence
  Description of Artificial Sequence: Synthetic polypeptide
DVQLTQSPSIMSASLGDRVTMTCTASSSVISTYLHWYQQKPGSSPKLWIYSTSTLASGVPPRFSGSGSGTDYSLTISSMEPEDAATYYCLQYHRSPRTFGGGTKVEIK

SEQ ID NO: 3050 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTWTFGQGTKVEIK

SEQ ID NO: 3051 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3052 - protein, 453 aa, Artificial Sequence; identical to SEQ ID NO: 3000
  Description of Artificial Sequence: Synthetic polypeptide

SEQ ID NO: 3053 - protein, 505 aa, Artificial Sequence; identical to SEQ ID NO: 3001
  Description of Artificial Sequence: Synthetic polypeptide

SEQ ID NO: 3054 - protein, 135 aa, Artificial Sequence; identical to SEQ ID NO: 2994
  Description of Artificial Sequence: Synthetic polypeptide

SEQ ID NO: 3055 - protein, 130 aa, Artificial Sequence; identical to SEQ ID NO: 2995
  Description of Artificial Sequence: Synthetic polypeptide

SEQ ID NO: 3056 - protein, 137 aa, Artificial Sequence
  Description of Artificial Sequence: Synthetic polypeptide
QVQLVESGGGLVQPGGSLRLSCAASGFTLDYYAIGWFRQAPGKEREGVSGISSVDGSTYYADSVRGRFTISRDNAKNTVYLQMNSLKPEDTAVYYCAADQSPIPIHYSRTYSGPYGMDYWGKGTLVTVSSAHHSEDP

SEQ ID NO: 3057 - protein, 139 aa, Artificial Sequence; identical to SEQ ID NO: 2997
  Description of Artificial Sequence: Synthetic polypeptide

SEQ ID NO: 3058 - protein, 136 aa, Artificial Sequence
  Description of Artificial Sequence: Synthetic polypeptide
QLQLVETGGGLVQAGGSLRLSCAASGRTLSNYPMGWFRQAPGKEREFVAAIRRIADGTYYADSVKGRFTISRDNAWNTLYLQMNGLKPEDTAVYFCATGPGAFPGMVVTNPSAYPYWGQGTQVTVSSEPKTPKPQP

SEQ ID NO: 3059 - protein, 139 aa, Artificial Sequence; identical to SEQ ID NO: 2999
  Description of Artificial Sequence: Synthetic polypeptide

SEQ ID NO: 3060 - protein, 135 aa, Artificial Sequence; identical to SEQ ID NO: 2992
  Description of Artificial Sequence: Synthetic polypeptide

SEQ ID NO: 3061 - protein, 123 aa, Artificial Sequence; identical to SEQ ID NO: 3003
  Description of Artificial Sequence: Synthetic polypeptide

SEQ ID NO: 3062 - protein, 135 aa, Artificial Sequence; identical to SEQ ID NO: 3004
  Description of Artificial Sequence: Synthetic polypeptide

SEQ ID NO: 3063 - protein, 119 aa, Artificial Sequence; identical to SEQ ID NO: 2949
  Description of Artificial Sequence: Synthetic polypeptide

SEQ ID NO: 3064 - protein, 124 aa, Artificial Sequence; identical to SEQ ID NO: 3006
  Description of Artificial Sequence: Synthetic polypeptide

SEQ ID NO: 3065 - protein, 123 aa, Artificial Sequence; identical to SEQ ID NO: 3007
  Description of Artificial Sequence: Synthetic polypeptide

SEQ ID NO: 3066 - protein, 131 aa, Artificial Sequence; identical to SEQ ID NO: 3008
  Description of Artificial Sequence: Synthetic polypeptide

SEQ ID NO: 3067 - protein, 125 aa, Artificial Sequence; identical to SEQ ID NO: 3009
  Description of Artificial Sequence: Synthetic polypeptide

SEQ ID NO: 3068 - protein, 121 aa, Artificial Sequence; identical to SEQ ID NO: 3010
  Description of Artificial Sequence: Synthetic polypeptide

SEQ ID NO: 3069 - protein, 124 aa, Artificial Sequence; identical to SEQ ID NO: 3011
  Description of Artificial Sequence: Synthetic polypeptide

SEQ ID NO: 3070 - protein, 122 aa, Artificial Sequence; identical to SEQ ID NO: 3012
  Description of Artificial Sequence: Synthetic polypeptide

SEQ ID NO: 3071 - protein, 129 aa, Artificial Sequence; identical to SEQ ID NO: 3013
  Description of Artificial Sequence: Synthetic polypeptide

SEQ ID NO: 3072 - protein, 452 aa, Artificial Sequence
  Description of Artificial Sequence: Synthetic polypeptide
QVQLVESGGGVVQPGRSLRLSCAASGFSFSNYGMHWVRQAPGKGLEWVALIWYDGSNEDYTDSVKGRFTISRDNSKNTLYLQMNSLRAEDTAVYYCARWGMVRGVIDVFDIWGQGTVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3073 - protein, 214 aa, Artificial Sequence
  Description of Artificial Sequence: Synthetic polypeptide
DIQMTQSPSSVSASVGDRVTITCRASQGISSWLAWYQHKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3074 - protein, 122 aa, Artificial Sequence; identical to SEQ ID NO: 2987
  Description of Artificial Sequence: Synthetic polypeptide

SEQ ID NO: 3075 - protein, 107 aa, Artificial Sequence; identical to SEQ ID NO: 3045
  Description of Artificial Sequence: Synthetic polypeptide

SEQ ID NO: 3076 - protein, 119 aa, Artificial Sequence; identical to SEQ ID NO: 3002
  Description of Artificial Sequence: Synthetic polypeptide

SEQ ID NO: 3077 - protein, 108 aa, Artificial Sequence; identical to SEQ ID NO: 3050
  Description of Artificial Sequence: Synthetic polypeptide

SEQ ID NO: 3078 - protein, 125 aa, Artificial Sequence
  Description of Artificial Sequence: Synthetic polypeptide
QVKLEESGGGLVQAGGSLRLSCAASGRTFNTLSMGWFRQAPGKEREFVAAVSRSGGSTYYADSVKGRFTISRDNAKNTVYLQMNSLKPEDTAVYYCAAAATKSNTTAYRLSFDYWGQGTQVTVSS

SEQ ID NO: 3079 - protein, 124 aa, Artificial Sequence [sequence omitted]

SEQ ID NO: 3080 - protein, 128 aa, Artificial Sequence
  Description of Artificial Sequence: Synthetic polypeptide
QVKLEESGGGLVQPGGSLRLSCAASGRTLSSYIVAWFRQAPGKEREFVAGISRRGGNSAYVESVKGRFTISRDNAKNTVYLQMNSLKPEDTAVYYCAADGSVAGWGRRSVSVSSYDYWGQGTQVTVSS

SEQ ID NO: 3081 - protein, 123 aa, Artificial Sequence
  Description of Artificial Sequence: Synthetic polypeptide
QVQLVESGGGLAQAGGSLRLSCAASGRTFSMDPMAWFRQPPGKEREFVAAGSSTGRTTYYADSVKGRFTISRDNAKNTVYLQMNSLKPEDTAVYYCAAAPYGANWYRDEYAYWGQGTQVTVSS

SEQ ID NO: 3082 - protein, 124 aa, Artificial Sequence [sequence omitted]

SEQ ID NO: 3083 - protein, 124 aa, Artificial Sequence
  Description of Artificial Sequence: Synthetic polypeptide
QVKLEESGGGLVQAGGSLRLSCAASERTFSRYPVAWFRQAPGAEREFVAVISSTGTSTYYADSVKGRFTISRDNAKVTVYLQMNNLKREDTAVYFCAVNSQRTRLQDPNEYDYWGQGTQVTVSS

SEQ ID NO: 3084 - protein, 121 aa, Artificial Sequence
  Description of Artificial Sequence: Synthetic polypeptide
QVQLVESGGGLVQPGGSLRLSCAASGNIFSINTMGWYRQAPGKQLELVAAITSGGTTSYTDSVEGRFTISRDNAKNAVYLQMNSLKAEDTAVYYCNTVKVVGGRLDNPDYWGQGTQVTVSS

SEQ ID NO: 3085 - protein, 127 aa, Artificial Sequence
  Description of Artificial Sequence: Synthetic polypeptide
QVKLEESGGGLVQPGGSLRLSCAASGRTASGYGMGWFRQAPGKEREFVAAISRSGAGTLNADFVKGRFTISRDNAKNTVYLQMNSLKPEDTAVYYCVARPTKVDRDYATRREMYNYWGQGTQVTVSS

SEQ ID NO: 3086 - protein, 121 aa, Artificial Sequence
  Description of Artificial Sequence: Synthetic polypeptide
QVKLEESGGGLVQAGGSLRLSCSASGRTFSSGVMGWFRQAPGKQRELVAAITTGGSTSYTDSVKGRFTISRDNAKNIVYLQMNSLKPEDTAVYYCNSVAVVGGVIKSPDYWGQGTQVTVSS

SEQ ID NO: 3087 - protein, 122 aa, Artificial Sequence
  Description of Artificial Sequence: Synthetic polypeptide
QVQLVESGGGSVQAGGSLRLSCAASGLSRYAMAWFRQGTGKEREFVASTNWSSGNTPYADSVKGRFIISRDNAKNTVYLQMNSLKPGDTAIYYCAARKLDVPSRYSQHYDYWGQGTQVTVSS

SEQ ID NO: 3088 - protein, 121 aa, Artificial Sequence
  Description of Artificial Sequence: Synthetic polypeptide
QVQLVESGGDLVQAGGSLRLSCAASGSISRISTMGWYRQAPGKQRELVATISTGGTTNYAESVKGRFTVSRDNAKNTMYLQMNSLKPEDTAVYYCAAGWKVVRGSLEYEYSGQGTQVTVSS

SEQ ID NO: 3089 - protein, 125 aa, Artificial Sequence
  Description of Artificial Sequence: Synthetic polypeptide
  MOD_RES (3)..(3): Any amino acid
  MOD_RES (5)..(5): Any amino acid
  MOD_RES (49)..(49): Any amino acid
  MOD_RES (70)..(70): Any amino acid
QVXLXESGGGLVQAGGSRRLSCATSGLTFRNFHMAWFRQVAGKEREVVXAISWSRDRQYYPDPVKGRFTXTRDNAKNTVYLQMNSLKPEDTAVYYCAARTASASGDWYKGSYQYWGQGTQVTVSS

SEQ ID NO: 3090 - protein, 125 aa, Artificial Sequence
  Description of Artificial Sequence: Synthetic polypeptide
QVKLEESGGGLVQAGGSRRLSCATSGLTFRNFHMAWFRQVAGKEREVVAAISWSRDRQYYPDPVKGRFTITRDNAKNTVYLQMNSLKPEDTAVYYCAARTASASGDWYKGSYQYWGQGTQVTVSS

SEQ ID NO: 3091 - protein, 125 aa, Artificial Sequence
  Description of Artificial Sequence: Synthetic polypeptide
QVQLVESGGGLVQAGGSRRLSCATSGLTFRNFHMAWFRQVAGKEREVVAAISWSRDRQYYPDPVKGRFTITRDNAKNTVYLQMNSLKPEDTAVYYCAARTASASGDWYKGSYQYWGQGTQVTVSS

SEQ ID NO: 3092 - protein, 125 aa, Artificial Sequence
  Description of Artificial Sequence: Synthetic polypeptide
QVKLEESGGGLVQAGGSRRLSCATSGLTFRNFHMAWFRQVAGKEREVVCAISWSRDRQYYPDPVKGRFTCTRDNAKNTVYLQMNSLKPEDTAVYYCAARTASASGDWYKGSYQYWGQGTQVTVSS

SEQ ID NO: 3093 - protein, 125 aa, Artificial Sequence
  Description of Artificial Sequence: Synthetic polypeptide
QVQLVESGGGLVQAGGSRRLSCATSGLTFRNFHMAWFRQVAGKEREVVCAISWSRDRQYYPDPVKGRFTCTRDNAKNTVYLQMNSLKPEDTAVYYCAARTASASGDWYKGSYQYWGQGTQVTVSS

SEQ ID NO: 3094 - protein, 128 aa, Artificial Sequence
  Description of Artificial Sequence: Synthetic polypeptide
  MOD_RES (3)..(3): Any amino acid
  MOD_RES (5)..(5): Any amino acid
  MOD_RES (49)..(49): Any amino acid
  MOD_RES (69)..(69): Any amino acid
QVXLXESGGGLVQAGGSLRVSCTASVSTFSINALGWYRQAPGKARELVXAIGSDGTVYYTDSVKGRFTXSRDNAKNTVSLQMSSLKPEDTAVYYCNAAGKRIGSDGSIWFAVASFGSWGQGTQVTVSS

SEQ ID NO: 3095 - protein, 128 aa, Artificial Sequence
  Description of Artificial Sequence: Synthetic polypeptide
QVKLEESGGGLVQAGGSLRVSCTASVSTFSINALGWYRQAPGKARELVAAIGSDGTVYYTDSVKGRFTISRDNAKNTVSLQMSSLKPEDTAVYYCNAAGKRIGSDGSIWFAVASFGSWGQGTQVTVSS

SEQ ID NO: 3096 - protein, 128 aa, Artificial Sequence
  Description of Artificial Sequence: Synthetic polypeptide
QVQLVESGGGLVQAGGSLRVSCTASVSTFSINALGWYRQAPGKARELVAAIGSDGTVYYTDSVKGRFTISRDNAKNTVSLQMSSLKPEDTAVYYCNAAGKRIGSDGSIWFAVASFGSWGQGTQVTVSS

SEQ ID NO: 3097 - protein, 128 aa, Artificial Sequence
  Description of Artificial Sequence: Synthetic polypeptide
QVKLEESGGGLVQAGGSLRVSCTASVSTFSINALGWYRQAPGKARELVCAIGSDGTVYYTDSVKGRFTCSRDNAKNTVSLQMSSLKPEDTAVYYCNAAGKRIGSDGSIWFAVASFGSWGQGTQVTVSS

SEQ ID NO: 3098 - protein, 128 aa, Artificial Sequence
  Description of Artificial Sequence: Synthetic polypeptide
QVQLVESGGGLVQAGGSLRVSCTASVSTFSINALGWYRQAPGKARELVCAIGSDGTVYYTDSVKGRFTCSRDNAKNTVSLQMSSLKPEDTAVYYCNAAGKRIGSDGSIWFAVASFGSWGQGTQVTVSS

SEQ ID NO: 3099 - protein, 108 aa, Artificial Sequence
  Description of Artificial Sequence: Synthetic polypeptide
QLQLVESGGGLVQAGGAMGWFRQAPGKEREFVAAISRSGVNTRYEDSVKGRSTISRDNAKRSVFLQMDSLKRDDTAVYYCAARRGPGTSVLSDDYDYWGQGTQVTVSS

SEQ ID NO: 3100 - protein, 178 aa, Artificial Sequence
  Description of Artificial Sequence: Synthetic polypeptide
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSEPKIPQPQPKPQPQPQPQPKPQPKPEPMECGRYPYDVPDYGSGRA

SEQ ID NO: 3101 - protein, 128 aa, Artificial Sequence
  Description of Artificial Sequence: Synthetic polypeptide
EVQLQASGGGSVQAGQSLRLSCATSGATSSSNCMGWFRQAPGKEREGVAVIDTGRGNTAYADSVQGRLTISLDNAKNTLYLQMNSLKPEDTAMYYCAADTSTWYRGYCGTNPNYFSYWGQGTQVTVSS

SEQ ID NO: 3102 - protein, 303 aa, Artificial Sequence
  Description of Artificial Sequence: Synthetic polypeptide
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSEPKIPQPQPKPQPQPQPQPKPQPKPEPMAEVQLQASGGGSVQAGQSLRLSCATSGATSSSNCMGWFRQAPGKEREGVAVIDTGRGNTAYADSVQGRLTISLDNAKNTLYLQMNSLKPEDTAMYYCAADTSTWYRGYCGTNPNYFSYWGQGTQVTVSSGRYDVPDYGSGRA

SEQ ID NO: 3103 - protein, 231 aa, Artificial Sequence
  Description of Artificial Sequence: Synthetic polypeptide
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARGGVAGRTEIYYYYYGMDVWGQGTTVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 3104 - protein, 113 aa, Artificial Sequence
  Description of Artificial Sequence: Synthetic polypeptide
QVQLQQSGAELVGPGASVTLSCKASGHTFTDYEMHWVKQTPVHGLEWIGGIDPETGGTAYNQKLKGEATLTADKSSNTAYMELRSLTSEDSAVYYCTIYLDYWGRGTTLTVSS

SEQ ID NO: 3105 - protein, 119 aa, Artificial Sequence
  Description of Artificial Sequence: Synthetic polypeptide
EVQLLESGGALVQPGGSLRLSCAASGFTFSSYAMSWARQAPGKGLEWLSGISGSADNTYYAESVKGRFTTSRDNSMNMLYLQMNSLRDEDTAFYYCAKGDQDRGPLEFWGQGTLVTVSS

SEQ ID NO: 3106 - protein, 113 aa, Artificial Sequence; identical to SEQ ID NO: 3104
  Description of Artificial Sequence: Synthetic polypeptide

SEQ ID NO: 3107 - protein, 169 aa, Artificial Sequence
  Description of Artificial Sequence: Synthetic polypeptide
AAANSPFADPNTAFAGFDENKVTVLTIVTEHTDLTMGWSSIILFLLATATGVHSQVQLQQPGAELVRPGASVKLSCKASGYSFTSDWMNWVKQRPGQGLEWIGIIHPSDSETKINQYFKDKATLTIDKSSSTAYMQLSSPTSEDSAVYYCVRWVGYHAQVWGQGTTLTV

SEQ ID NO: 3108 - protein, 120 aa, Artificial Sequence
  Description of Artificial Sequence: Synthetic polypeptide
QVQLVQSGGGIGQPGGSLRLACEASGFTFNLFEMAWVRQAPGQSLEVISYIGSSGSTTRYADSVKGRFIVSRDNDKESMFLQLNSLRVDDTATYFCARLNGWAGSGLDHWGQGTLVAVSS

SEQ ID NO: 3109 - protein, 98 aa, Artificial Sequence
  Description of Artificial Sequence: Synthetic polypeptide
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCAR

SEQ ID NO: 3110 - protein, 120 aa, Artificial Sequence
  Description of Artificial Sequence: Synthetic polypeptide
QVQLVQSGGGIGQPGGSLRLACEASGFTFNLFEMAWVRQAPGQGLEVISYIGSSGSTTRYADSVKGRFIVSRDNDKESMFLQLNSLRVDDTATYFCARLNGWAGSGLDHWGQGTLVAVSS

SEQ ID NO: 3111 - protein, 120 aa, Artificial Sequence
  Description of Artificial Sequence: Synthetic polypeptide
QVQLVQSGGAWGQPGASLRLSCEVSGFPFNLYEMIWVRQAPGKGLEWVAYIGSSGTLMKYADSVKGRLTISRDNSKNSLYLHLNSPEVEDTAIYYCARFNGWSGSGLDYWGQGTLVAVSS

SEQ ID NO: 3112 - protein, 98 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 3113 - protein, 124 aa, Artificial Sequence
  Description of Artificial Sequence: Synthetic polypeptide
QVQLQQSGAEVKTPGASVKVSCKASGYDFKAHGMSWVRQAPGQGPEWMGWISGNNYNTTYAQSVRGRVTVTTDTSTTTVYMELKNLRSDDTAVYFCARDQGGSRFGELLILDYWGQGTLVTVSS

SEQ ID NO: 3114 - protein, 165 aa, Artificial Sequence
  Description of Artificial Sequence: Synthetic polypeptide
DSHAKRHHGYKRKFHEKHHSHRGYSGGGGSGGGGSGGGGSDVKLVESGGGLVNPGGSLKLSCAASGFTFSSYTMSWVRQTPEKRLEWVASISSGGTYTYYPDSVKGRFTISRDNAKNTLYLQMTSLKSGDTAMYYCSRDDGSYGSYYYAMDYWGQGTSVTVSSAS

SEQ ID NO: 3115 - protein, 125 aa, Artificial Sequence
  Description of Artificial Sequence: Synthetic polypeptide
DVKLVESGGGLVNPGGSLKLSCAASGFTFSSYTMSWVRQTPEKRLEWVASISSGGTYTYYPDSVKGRFTISRDNAKNTLYLQMTSLKSEDTAMYYCSRDDGSYGSYYYAMDYWGQGTSVTVSSAS

SEQ ID NO: 3116 - protein, 125 aa, Artificial Sequence; identical to SEQ ID NO: 3115
  Description of Artificial Sequence: Synthetic polypeptide

SEQ ID NO: 3117 - protein, 439 aa, Artificial Sequence
  Description of Artificial Sequence: Synthetic polypeptide
QSLEESGGRLVTPGTPLTLTCTVSGLDLSSYYMQWVRQAPGKGLEWIGVIGINDNTYYASWAKGRFTISRASSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3118 - protein, 441 aa, Artificial Sequence
  Description of Artificial Sequence: Synthetic polypeptide
EVQLVESGGGLVQPGGSLRLSCAVSGLDLSSYYMQWVRQAPGKGLEWVGVIGINDNTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3119 - protein, 441 aa, Artificial Sequence
  Description of Artificial Sequence: Synthetic polypeptide
EVQLVESGGGLVQPGGSLRLSCAVSGLDLSSYYMQWVRQAPGKGLEWVGVIGINDNTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3120 - protein, 439 aa, Artificial Sequence
  Description of Artificial Sequence: Synthetic polypeptide
QSLEESGGRLVTPGTPLTLTCSVSGIDLSGYYMNWVRQAPGKGLEWIGVIGINGATYYASWAKGRFTISKTSSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3121 - protein, 441 aa, Artificial Sequence
  Description of Artificial Sequence: Synthetic polypeptide
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3122 - protein, 441 aa, Artificial Sequence
  Description of Artificial Sequence: Synthetic polypeptide
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3123 - protein, 440 aa, Artificial Sequence
  Description of Artificial Sequence: Synthetic polypeptide
QEQLKESGGRLVTPGTSLTLTCTVSGIDLSNHYMQWVRQAPGKGLEWIGVVGINGRTYYASWAKGRFTISRTSSTTVDLKMTRLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3124 - protein, 441 aa, Artificial Sequence
  Description of Artificial Sequence: Synthetic polypeptide
EVQLVESGGGLVQPGGSLRLSCAVSGIDLSNHYMQWVRQAPGKGLEWVGVVGINGRTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3125 - protein, 439 aa, Artificial Sequence
  Description of Artificial Sequence: Synthetic polypeptide
QSLEESGGRLVTPGTPLTLTCTVSGIGLSSYYMQWVRQSPGRGLEWIGVIGSDGKTYYATWAKGRFTISKTSSTTVDLRMASLTTEDTATYFCTRGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3126 - protein, 441 aa, Artificial Sequence
  Description of Artificial Sequence: Synthetic polypeptide
EVQLVESGGGLVQPGGSLRLSCAVSGIGLSSYYMQWVRQAPGKGLEWVGVIGSDGKTYYATWAKGRFTISRDNSKTTVYLQMNSLRAEDTAVYFCTRGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3127 - protein, 439 aa, Artificial Sequence
  Description of Artificial Sequence: Synthetic polypeptide
QSLEESGGRLVTPGGSLTLTCTVSGIDVTNYYMQWVRQAPGKGLEWIGVIGVNGKRYYASWAKGRFTISKTSSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3128 - protein, 441 aa, Artificial Sequence
  Description of Artificial Sequence: Synthetic polypeptide
EVQLVESGGGLVQPGGSLRLSCAVSGIDVTNYYMQWVRQAPGKGLEWVGVIGVNGKRYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3129 - protein, 441 aa, Artificial Sequence
  Description of Artificial Sequence: Synthetic polypeptide
QSVEESGGGLVQPEGSLTLTCTASGFDFSSNAMWWVRQAPGKGLEWIGCIYNGDGSTYYASWVNGRFSISKTSSTTVTLQLNSLTVADTATYYCARDLDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3130 - protein, 441 aa, Artificial Sequence
  Description of Artificial Sequence: Synthetic polypeptide
EVQLVESGGGLVQPGGSLRLSCAVSGIGLSSYYMQWVRQAPGKGLEWVGVIGSDGKTYYATWAKGRFTISRDNSKTTVYLQMNSLRAEDTAVYFCTRGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3131 - protein, 208 aa, Artificial Sequence
  Description of Artificial Sequence: Synthetic polypeptide
MLVESGGGLVQPGGSMKLSCIVSGFTFSYYWMSWVRQSPEKGFEWVAEIRLKSENYATNYTESVKGKFTISRDDSKSRLYLQMNSLGAEDTGIYYCLTGYAWFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTK

SEQ ID NO: 3132 - protein, 464 aa, Artificial Sequence
  Description of Artificial Sequence: Synthetic polypeptide
MGRLTSSFLLLIVPAYVLSQVTLKESGPGILQPSQTLSLTCSFSGISLTTSGMGVGWIRQPSGEGLEWLADIFWDDNKYYNPSLKSRLTISKDTSTKQVFFKITSVDTADTATYYCVRVYYKNDGYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 3133 - protein, 86 aa, Artificial Sequence
  Description of Artificial Sequence: Synthetic polypeptide
  MOD_RES (1)..(1): Any amino acid
  MOD_RES (16)..(16): Any amino acid
  MOD_RES (24)..(24): Any amino acid
  MOD_RES (27)..(27): Any amino acid
  MOD_RES (29)..(29): Any amino acid
  MOD_RES (37)..(37): Any amino acid
  MOD_RES (39)..(39): Any amino acid
  MOD_RES (41)..(42): Any amino acid
  MOD_RES (44)..(44): Any amino acid
  MOD_RES (48)..(48): Any amino acid
  MOD_RES (55)..(55): Any amino acid
  MOD_RES (58)..(58): Any amino acid
  MOD_RES (63)..(63): Any amino acid
  MOD_RES (69)..(69): Any amino acid
  MOD_RES (75)..(75): Any amino acid
XVQLQASGGGSVQAGXSLRLSCAXSGXWXRQAPGKEXEXVXXRXTISXDNAKNTXYLXMNSLXPEDTAXYYCAAXWGQGTQVTVSS

SEQ ID NO: 3134 - protein, 87 aa, Artificial Sequence
  Description of Artificial Sequence: Synthetic polypeptide
  MOD_RES (1)..(1): Any amino acid
  MOD_RES (16)..(16): Any amino acid
  MOD_RES (24)..(24): Any amino acid
  MOD_RES (27)..(28): Any amino acid
  MOD_RES (30)..(30): Any amino acid
  MOD_RES (38)..(38): Any amino acid
  MOD_RES (40)..(40): Any amino acid
  MOD_RES (42)..(43): Any amino acid
  MOD_RES (45)..(45): Any amino acid
  MOD_RES (49)..(49): Any amino acid
  MOD_RES (56)..(56): Any amino acid
  MOD_RES (59)..(59): Any amino acid
  MOD_RES (64)..(64): Any amino acid
  MOD_RES (70)..(70): Any amino acid
  MOD_RES (76)..(76): Any amino acid
XVQLQASGGGSVQAGXSLRLSCAXSGXXWXRQAPGKEXEXVXXRXTISXDNAKNTXYLXMNSLXPEDTAXYYCAAXWGQGTQVTVSS

SEQ ID NO: 3135 - protein, 472 aa, Artificial Sequence
  Description of Artificial Sequence: Synthetic polypeptide
MGWSCIILFLVATATGVHSEVQLVESGGGLVQPGGSLRLSCSASGFTFSSYWMSWVRQAPGKGLEWVANIIQDGSEKYYADSVKGRLTISRDNAKNSLYLQMNSLRVDDTAVYYCARGYEGCSATRCYLYYFDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSGPPCPPCPAPELLGGPSVFLFPPKPKDTLMISRTPEVTCVVVDVSHEDPEVKFNWYVDGVEVHNAKTKPREEQYNSTYRVVRVLTVLHQDWLNGKEYKCKVSNKALPAPIEKTISKAKGQPREPQVYTLPPSREEMTKNQVSLTCLVKGFYPSDIAVEWESNGQPEDNYKTTPPVLDSDGSFFLYSKLTVDKSRWQQGNVFSCSVMHEALHNHYTQKSLSLSLGK

SEQ ID NO: 3136 - protein, 470 aa, Artificial Sequence
  Description of Artificial Sequence: Synthetic polypeptide
MGWSCIILFLVATATGVHSEVQLLQSGAGLLKPSETLSLTCAVYGGSFSGYYWSWIRQAPGKGLEWIGEIDHSGTTNYNPSLKSRVTISVETSKNQFSLRLSSVTAADSAVYYCASSGYCSHGLCPQEDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3137 - protein, 470 aa, Artificial Sequence
  Description of Artificial Sequence: Synthetic polypeptide
MGWSCIILFLVATATGVHSEVQLEESGAGLLKPSETLSLTCAVYGGSFSGYYWSWIRQAPGKGLEWIGEIDHSGTTNYNPSLKSRVTISVETSKNQFSLRLSSVTAADSAVYYCASSGYCSHGLCPQEDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAVPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3138 - protein, 475 aa, Artificial Sequence
  Description of Artificial Sequence: Synthetic polypeptide
MGWSCIILFLVATATGVHSQVQLLESGGGLVQPGGSLRLSCAASGFSFGDYWMSWVRQAPGKGLEWVADIKPDGSDKDYVDSVKGRFTISRDNAKNSLYLQMSSLRGEDTAVYYCARDYVVVAPSQPPNIHPEYFQNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3139 - protein, 106 aa, Artificial Sequence
  Description of Artificial Sequence: Synthetic polypeptide
QIVLTQSPAIMSASPGEKVTMTCSANSSINYMHWYQQKPGTSPKRWIYDTTILASGVPARFSGSGSGTSYSLTISSMEAEDAATYYCHQRSSYPFTFGSGTKLEIK

SEQ ID NO: 3140 - protein, 108 aa, Artificial Sequence
  Description of Artificial Sequence: Synthetic polypeptide
SYELTQPPSVSVSPGQTARITCSGDALPKQYAYWYQQKPGQAPVLLIYQDTKRPSGIPERFSGSSSGTTVALTISGVQAEDEADYYCQSADSNDSYYVFGTGTKVTVL

SEQ ID NO: 3141 - protein, 113 aa, Artificial Sequence
  Description of Artificial Sequence: Synthetic polypeptide
QVLTQTASPVSAAVGSTVTINCQASQSVYDNNYLAWYQQKPGQPPKQLIYSTSTLASGVSSRFKGSGSGTQFTLTISDLECADAATYYCLGSYDCSSGDCFVFGGGTEVVVKR

SEQ ID NO: 3142 - protein, 106 aa, Artificial Sequence; identical to SEQ ID NO: 3139
  Description of Artificial Sequence: Synthetic polypeptide

SEQ ID NO: 3143 - protein, 140 aa, Artificial Sequence
  Description of Artificial Sequence: Synthetic polypeptide
ISQEQKFKDKMDFQVQIFSFLLISFSVIMSRGQIVLTQSPAIMSVSPGEKVTLTCNASSSVSSSYLYWYRQKPGSSPNLWIYSTSNLASGVPARFSGSGSGTSYSLTISSMEAEDVASYFCHQWSSYPLTFGAGTKLELK

SEQ ID NO: 3144 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 3145 - protein, 155 aa, Artificial Sequence
  Description of Artificial Sequence: Synthetic polypeptide
KRLFKELKFSLRKYSGGGGSGGGGSGGGGSDVKLVESGGGLVNPGGSLKLSCAASGFTFSSYTMSWVRQTPEKRLEWVASISSGGTYTYYPDSVKGRFTISRDNAKNTLYLQMTSLKSEDTAMYYCSRDDGSYGSYYYAMDYWGQGTSVTVSSAS

SEQ ID NO: 3146 - protein, 219 aa, Artificial Sequence
  Description of Artificial Sequence: Synthetic polypeptide
QVLTQTASPVSAAVGSTVTINCQASQSVYDNNYLAWYQQKPGQPPKQLIYSTSTLASGVSSRFKGSGSGTQFTLTISDLECADAATYYCLGSYDCSSGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3147 - protein, 439 aa, Artificial Sequence; identical to SEQ ID NO: 3117
  Description of Artificial Sequence: Synthetic polypeptide

SEQ ID NO: 3148 - protein, 219 aa, Artificial Sequence
  Description of Artificial Sequence: Synthetic polypeptide
QVLTQSPSSLSASVGDRVTINCQASQSVYDNNYLAWYQQKPGKVPKQLIYSTSTLASGVPSRFSGSGSGTDFTLTISSLQPEDVATYYCLGSYDCSSGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3149 - protein, 441 aa, Artificial Sequence; identical to SEQ ID NO: 3118
  Description of Artificial Sequence: Synthetic polypeptide

SEQ ID NO: 3150 - protein, 219 aa, Artificial Sequence; identical to SEQ ID NO: 3148
  Description of Artificial Sequence: Synthetic polypeptide

SEQ ID NO: 3151 - protein, 441 aa, Artificial Sequence; identical to SEQ ID NO: 3119
  Description of Artificial Sequence: Synthetic polypeptide

SEQ ID NO: 3152 - protein, 219 aa, Artificial Sequence
  Description of Artificial Sequence: Synthetic polypeptide
QVLTQTPSPVSAAVGSTVTINCQASQSVYHNTYLAWYQQKPGQPPKQLIYDASTLASGVPSRFSGSGSGTQFTLTISGVQCNDAAAYYCLGSYDCTNGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3153 - protein, 439 aa, Artificial Sequence; identical to SEQ ID NO: 3120
  Description of Artificial Sequence: Synthetic polypeptide

SEQ ID NO: 3154 - protein, 219 aa, Artificial Sequence
  Description of Artificial Sequence: Synthetic polypeptide
QVLTQSPSSLSASVGDRVTINCQASQSVYHNTYLAWYQQKPGKVPKQLIYDASTLASGVPSRFSGSGSGTDFTLTISSLQPEDVATYYCLGSYDCTNGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3155 - protein, 441 aa, Artificial Sequence; identical to SEQ ID NO: 3121
  Description of Artificial Sequence: Synthetic polypeptide

SEQ ID NO: 3156 - protein, 219 aa, Artificial Sequence; identical to SEQ ID NO: 3154
  Description of Artificial Sequence: Synthetic polypeptide

SEQ ID NO: 3157 - protein, 441 aa, Artificial Sequence; identical to SEQ ID NO: 3122
  Description of Artificial Sequence: Synthetic polypeptide

SEQ ID NO: 3158 - protein, 219 aa, Artificial Sequence
  Description of Artificial Sequence: Synthetic polypeptide
QVLTQTASPVSAAVGSTVTINCQASQSVYNYNYLAWYQQKPGQPPKQLIYSTSTLASGVSSRFKGSGSGTQFTLTISDVQCDDAATYYCLGSYDCSTGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3159 - protein, 440 aa, Artificial Sequence; identical to SEQ ID NO: 3123
  Description of Artificial Sequence: Synthetic polypeptide

SEQ ID NO: 3160 - protein, 219 aa, Artificial Sequence
  Description of Artificial Sequence: Synthetic polypeptide
QVLTQSPSSLSASVGDRVTINCQASQSVYNYNYLAWYQQKPGKVPKQLIYSTSTLASGVPSRFSGSGSGTDFTLTISSLQPEDVATYYCLGSYDCSTGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3161 - protein, 441 aa, Artificial Sequence; identical to SEQ ID NO: 3124
  Description of Artificial Sequence: Synthetic polypeptide

SEQ ID NO: 3162 - protein, 219 aa, Artificial Sequence
  Description of Artificial Sequence: Synthetic polypeptide
QVLTQTPSPVSAAVGSTVTINCQASQNVYNNNYLAWYQQKPGQPPKQLIYSTSTLASGVSSRFRGSGSGTQFTLTISDVQCDDAATYYCLGSYDCSRGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3163 - protein, 439 aa, Artificial Sequence; identical to SEQ ID NO: 3125
  Description of Artificial Sequence: Synthetic polypeptide

SEQ ID NO: 3164 - protein, 219 aa, Artificial Sequence
  Description of Artificial Sequence: Synthetic polypeptide
QVLTQSPSSLSASVGDRVTINCQASQNVYNNNYLAWYQQKPGKVPKQLIYSTSTLASGVPSRFSGSGSGTDFTLTISSLQPEDVATYYCLGSYDCSRGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3165 - protein, 441 aa, Artificial Sequence; identical to SEQ ID NO: 3126
  Description of Artificial Sequence: Synthetic polypeptide

SEQ ID NO: 3166 - protein, 219 aa, Artificial Sequence
  Description of Artificial Sequence: Synthetic polypeptide
QVLTQTASPVSPAVGSTVTINCRASQSVYYNNYLAWYQQKPGQPPKQLIYSTSTLASGVSSRFKGSGSGTQFTLTISDVQCDDAATYYCLGSYDCSNGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3167 - protein, 439 aa, Artificial Sequence; identical to SEQ ID NO: 3127
  Description of Artificial Sequence: Synthetic polypeptide

SEQ ID NO: 3168 - protein, 219 aa, Artificial Sequence
  Description of Artificial Sequence: Synthetic polypeptide
QVLTQSPSSLSASVGDRVTINCRASQSVYYNNYLAWYQQKPGKVPKQLIYSTSTLASGVPSRFSGSGSGTDFTLTISSLQPEDVATYYCLGSYDCSNGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3169 - protein, 441 aa, Artificial Sequence; identical to SEQ ID NO: 3128
  Description of Artificial Sequence: Synthetic polypeptide

SEQ ID NO: 3170 - protein, 219 aa, Artificial Sequence
  Description of Artificial Sequence: Synthetic polypeptide
AIVMTQTPSSKSVPVGDTVTINCQASESLYNNNALAWFQQKPGQPPKRLIYDASKLASGVPSRFSGGGSGTQFTLTISGVQCDDAATYYCGGYRSDSVDGVAFAGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3171 - protein, 441 aa, Artificial Sequence; identical to SEQ ID NO: 3129
  Description of Artificial Sequence: Synthetic polypeptide

SEQ ID NO: 3172 - protein, 219 aa, Artificial Sequence; identical to SEQ ID NO: 3164
  Description of Artificial Sequence: Synthetic polypeptide

SEQ ID NO: 3173 - protein, 441 aa, Artificial Sequence; identical to SEQ ID NO: 3130
  Description of Artificial Sequence: Synthetic polypeptide

SEQ ID NO: 3174 - protein, 113 aa, Artificial Sequence
  Description of Artificial Sequence: Synthetic polypeptide
QVLTQSPSSLSASVGDRVTINCQASQSVYDNNYLAWYQQKPGKVPKQLIYSTSTLASGVPSRFSGSGSGTDFTLTISSLQPEDVATYYCLGSYDCSSGDCFVFGGGTKVEIKR

SEQ ID NO: 3175 - protein, 219 aa, Artificial Sequence; identical to SEQ ID NO: 3148
  Description of Artificial Sequence: Synthetic polypeptide

SEQ ID NO: 3176 - protein, 113 aa, Artificial Sequence
  Description of Artificial Sequence: Synthetic polypeptide
QVLTQTPSPVSAAVGSTVTINCQASQSVYHNTYLAWYQQKPGQPPKQLIYDASTLASGVPSRFSGSGSGTQFTLTISGVQCNDAAAYYCLGSYDCTNGDCFVFGGGTEVVVKR

SEQ ID NO: 3177 - protein, 219 aa, Artificial Sequence; identical to SEQ ID NO: 3154
  Description of Artificial Sequence: Synthetic polypeptide

SEQ ID NO: 3178 - protein, 219 aa, Artificial Sequence; identical to SEQ ID NO: 3154
  Description of Artificial Sequence: Synthetic polypeptide

SEQ ID NO: 3179 - protein, 113 aa, Artificial Sequence
  Description of Artificial Sequence: Synthetic polypeptide
QVLTQTASPVSAAVGSTVTINCQASQSVYNYNYLAWYQQKPGQPPKQLIYSTSTLASGVSSRFKGSGSGTQFTLTISDVQCDDAATYYCLGSYDCSTGDCFVFGGGTEVVVKR

SEQ ID NO: 3180 - protein, 113 aa, Artificial Sequence
  Description of Artificial Sequence: Synthetic polypeptide
QVLTQSPSSLSASVGDRVTINCQASQSVYNYNYLAWYQQKPGKVPKQLIYSTSTLASGVPSRFSGSGSGTDFTLTISSLQPEDVATYYCLGSYDCSTGDCFVFGGGTKVEIKR

SEQ ID NO: 3181 - protein, 219 aa, Artificial Sequence; identical to SEQ ID NO: 3162
  Description of Artificial Sequence: Synthetic polypeptide

SEQ ID NO: 3182 - protein, 113 aa, Artificial Sequence
  Description of Artificial Sequence: Synthetic polypeptide
QVLTQSPSSLSASVGDRVTINCQASQNVYNNNYLAWYQQKPGKVPKQLIYSTSTLASGVPSRFSGSGSGTDFTLTISSLQPEDVATYYCLGSYDCSRGDCFVFGGGTKVEIKR

SEQ ID NO: 3183 - protein, 219 aa, Artificial Sequence; identical to SEQ ID NO: 3166
  Description of Artificial Sequence: Synthetic polypeptide

SEQ ID NO: 3184 - protein, 219 aa, Artificial Sequence; identical to SEQ ID NO: 3168
  Description of Artificial Sequence: Synthetic polypeptide

SEQ ID NO: 3185 - protein, 219 aa, Artificial Sequence; identical to SEQ ID NO: 3170
  Description of Artificial Sequence: Synthetic polypeptide

SEQ ID NO: 3186 - protein, 219 aa, Artificial Sequence; identical to SEQ ID NO: 3164
  Description of Artificial Sequence: Synthetic polypeptide

SEQ ID NO: 3187 - protein, 177 aa, Artificial Sequence
  Description of Artificial Sequence: Synthetic polypeptide
DVQMIQSPKRLIYLVSKLDSGVPDRFTGSGSGTDFTLKISRVEAEDLGVYYCVQHTHFPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3188 - protein, 238 aa, Artificial Sequence
  Description of Artificial Sequence: Synthetic polypeptide
METDTLLLWVLLLWVPGSTGDIVLTQSPASLAVSLGQRATISCRASKSVTTSGYSFMHWYQQKPGQPPKLLIYLASNLEPGVPARFSGSGSGTDFALNILPVEEEDAATYYCQHSRELPYTFGGGTKLEMKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3189 - protein, 214 aa, Artificial Sequence
  Description of Artificial Sequence: Synthetic polypeptide
DVELTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3190 - protein, 233 aa, Artificial Sequence
  Description of Artificial Sequence: Synthetic polypeptide
MGWSCIILFLVATATGVHSSYVLTQPPSVSVSPGQTARITCSGDALPKQYTYWYQQKPGQAPVVVIYKDSERPSGIPERFSGSSSGTTVTVTISGVQAEDEADYYCQSADSSGTSLVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTESS

SEQ ID NO: 3191 - protein, 232 aa, Artificial Sequence
  Description of Artificial Sequence: Synthetic polypeptide
MGWSCIILFLVATATGVHSDIELTQSPSFLSASVGDRVAITCRASQGISNYLAWYQQKPGKAPKLLIYAAFVLQSGVPSRFSGSGSGTEFTLTISNLQPEDFATYYCQQLNSYPRAFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 3192 - protein, 229 aa, Artificial Sequence
  Description of Artificial Sequence: Synthetic polypeptide
MGWSCIILFLVATATGVHSLCADSATLSVSGPRRDGQHSCGGNNIGTKSVHWYQQRPGQAPLLVLYHDTRRPSRIPERFSGSNSGNTATLTISRVEAGDEADYYCQVWDSRRVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTESS

SEQ ID NO: 3193 - protein, 244 aa, Artificial Sequence
  Description of Artificial Sequence: Synthetic polypeptide
MQVKLQESGPELVKPGALVKISCKASGYTFTSYDINWVKQRPGQGLEWIGWIYPGDGSTKYNEKFKGKATLTADKSSSTAYMQLSSLTSENSAVYFCARYYRYYFDYWGQGTTVTVSSGGGGSGGGGSGGGGSDNVLTQSPAIMSASPGEKVTMTCSASSSVSYMHWFQQKPGTSPKLWIYSTSNLASGVPARFSGSGSGTSYSLTISRMEAEDAATYYCQQRSSYPFTFGSGTKLEIKRAAAE

SEQ ID NO: 3194 - protein, 243 aa, Artificial Sequence
  Description of Artificial Sequence: Synthetic polypeptide
MEVKLQETGPEVVKPGASVKLSCKASGYIFTSYDINWVRQTPEQGLEWIGWIFPGEGSTEYNEKFKGRATLSVDKSSSTAYMELTSLTSEDSAVYFCARGDYYRRYFDYWGQGTTVTVSSGGGGSGGGGSGGGGSDIELTQSPASLAVSLGQRATISYRASKSVSTSGYSYMHWNQQKPGQPPRLLIYLVSNLESGVPARFSGSGSGTDFTLNIHPVEEEDYCAYATQHIRELTRSEGGPSWK

SEQ ID NO: 3195 - protein, 127 aa, Artificial Sequence
  Description of Artificial Sequence: Synthetic polypeptide
EVQLQASGGGSVQAGGSLRLSCTAANYAFDSKTVGWFRQVPGKEREGVAGISSGGSTTAYSDSVKGRYTVSLENAKNTVYLLIDNLQPEDTAIYYCAGVSGWRGRQWLLLAETYRFWGQGTQVTVSS

SEQ ID NO: 3196 - protein, 119 aa, Artificial Sequence
  Description of Artificial Sequence: Synthetic polypeptide
EVQLQASGGGSVQAGGSLRLSCAASGGQTFDSYAMAWFRQAPGKECELVSSIIGDDNRNYADSVKGRFTISRDNAKNTVYLQMDRLNPEDTAVYYCAQLGSARSAMYCAGQGTQVTVSS

SEQ ID NO: 3197 - protein, 123 aa, Artificial Sequence
  Description of Artificial Sequence: Synthetic polypeptide
LESGGGLVQPGGSLRLSCAGSGFTFSSSAMSWVRQSPGKGLEWVSTISGFGGSTYYTDSVKGRFTISRDNYKNTLYLQMKSLRAEDTAVYYCAKVPFSGYDYVWGSYGYFDYWGQGTLVTVSS

SEQ ID NO: 3198 - protein, 120 aa, Artificial Sequence
  Description of Artificial Sequence: Synthetic polypeptide
LESGGGSVQPGGSLILSCAGSGFTFSSSAMSWVRQSPGKGLEWVSTISGFGGSTYYTDSVKGRFTISRDNYKNTLYLQMNSLRAEDTAVYYCAKVPLVDMITLGGVWLFDYWGQGTLVTV

SEQ ID NO: 3199 - protein, 123 aa, Artificial Sequence
  Description of Artificial Sequence: Synthetic polypeptide
LESGGGLVQPGGSLILSCAGSGFTFSSSAMSWVRQSPGKGLEWVSTISGFGGSTYYTDSVKGRFTISRDNYKNTLYLQMNSLRAEDTAVYYCAKVPFSGYDTLGGSYGYFDYWGQGTLVTVSS

SEQ ID NO: 3200 - protein, 128 aa, Artificial Sequence
  Description of Artificial Sequence: Synthetic polypeptide
LESGGGLVQPGGSLRLSCAGSGFTFSSSAMSWVRQSPGKGLEWVSTISGFGGSTYYTDSVKGRFTISRDNSKNTLYLQMKSLRAEDTAVYYCAKVPFSGYDTFGGVWLFDYWGQGTLVTVTCCTCASS

SEQ ID NO: 3201 - protein, 122 aa, Artificial Sequence
  Description of Artificial Sequence: Synthetic polypeptide
LESGGGLVQPGGSLILSCAGSGFTFSSSAMSWVRQSPGKGLEWVSTISGFGGSTYYTDSVKGRFTISRDNYKNTLYLQMKSLRAEDTAVYYCAKVPFSGYDTFGGVWLFDYWGQGTLVTVSS

SEQ ID NO: 3202 - protein, 117 aa, Artificial Sequence
  Description of Artificial Sequence: Synthetic polypeptide
DVQLQESGPGLVKPSQSLSLSCSVTGYSITSGYYWNWIRQFPGNKLEWMGYIGYDGSNKYNPSLKNRISITRDTSKNQFFLKLTSVTTGDTATYYCVRDVKYYFDYWGQGTTVTVSS

SEQ ID NO: 3203 - protein, 116 aa, Artificial Sequence
  Description of Artificial Sequence: Synthetic polypeptide
EVQLQQSGPELVKPGASVKMSCKASGYKFTSYVMHWVKQKPGQGLEWIGYINPSNDNIKYNEKFKGKAILTLDKSSSTAYMAFSSLTSEDSAVYYCATLTGVDYWGQGTTLTVSSA

SEQ ID NO: 3204 - protein, 124 aa, Artificial Sequence
  Description of Artificial Sequence: Synthetic polypeptide
QVTLKESGPGILQPSQTLSLTCSFSGFSLSTSGMGVGWIRQPSGKGLEWLAHIWWDDVKRYSPALKSRLTISKDTSSSQLFLKIASVDTADTATYYCARIKSVITTGDYALDYWGQGTSVAVSS

SEQ ID NO: 3205 - protein, 117 aa, Artificial Sequence
  Description of Artificial Sequence: Synthetic polypeptide
QVQLKESGPGLVAPSQSLSITCTVSGFSLIGYGVNWVRQPPEKGLEWLGMIWGDGSTDYNSALKSRLSITKDNSKSQVFLKMNSLQTDDTARYYCAMGVRPDPFDYWGQGTLVTVSA

SEQ ID NO: 3206 - protein, 131 aa, Artificial Sequence
  Description of Artificial Sequence: Synthetic polypeptide
EVQLLESGGSLVQPGGSLRLSCAASGFIFSNHAIHWVRQTSDKGLEWVATISGGGGATYYPDSVKGRETISRDNSKNMVYLQMNSLRAEDTAVYYCAKDVLNVFEAERNYGWSTGYSFDYWGQGTRVTVSS

SEQ ID NO: 3207 - protein, 126 aa, Artificial Sequence
  Description of Artificial Sequence: Synthetic polypeptide
EVQLLESGGSLVQPGGSLRLSCAASGFTFSDSWMHWVRQVPGKGLEWDDTISSDGDSTRYADSVQGRFIISRDNAKNTYLLQMNSLRVEDTAVYYCTRSPQYCSTTRCDWIHYDYWGQGTLVTVSS

SEQ ID NO: 3208 - protein, 124 aa, Artificial Sequence
  Description of Artificial Sequence: Synthetic polypeptide
QVQLQQWGAGLLKPSDTLSLTCTVYGGFLSGYYWTWVRQTPGKGLEWIGEIYYSGSTEYNPSLGSRVTMSVDRSKNQLSLKLSSVTAADTAVYYCARSSSFREFDVRRGAFDIWGQGTMVTVSS

SEQ ID NO: 3209 - protein, 129 aa, Artificial Sequence
  Description of Artificial Sequence: Synthetic polypeptide
QVQLQEWGPGLVRPSETLSLTCTVSGGSISPDYWSWIRQPPGKELEWIGYIYYSGSTNYNPSLKSRVAISVDTSKNQFSLKLSSVTAADTAVYYCARFSDYYVRDYYGSGTQRYGLDVWGQGTTVTVSS

SEQ ID NO: 3210 - protein, 123 aa, Artificial Sequence
  Description of Artificial Sequence: Synthetic polypeptide
EVQLLETGGGLVQPGGSLRLSCAASGFTFRNYGMNWVRQAPGKGLEWVAVIYGGGGRTHYADSVQGRFIISRDDSTNTMYLQMNSLRAEDTAVYYCAKDRMTSKVWDYGMDVWGQGTTVTVSS

SEQ ID NO: 3211 - protein, 129 aa, Artificial Sequence
  Description of Artificial Sequence: Synthetic polypeptide
QLQLQESGPGLVKPSGTLSLTCTVSGGSISRASDYWGWVRQSPGKGLEWLGSVYYSGTTFYNPSLKSRVTISVDTSKKRLSLKLSSVTAADTAVYYCARGGNDYGDHQTGSFYYGMDAWGHGTTVIVSS

SEQ ID NO: 3212 - protein, 229 aa, Artificial Sequence
  Description of Artificial Sequence: Synthetic polypeptide
QLQQSGPELVKPGASVKISCKASGYTFTDFNMHWVKQSHGKSLEWIGYIYPYNGITGQNQKFKSKATLTVDNSSSSAYMELRSLTSEDSAVYYCARERFGVGNNYAWFTYWGQGTLVTVSSAKTTPPSVYPLAPGPVSAAQTNSMVTLGCLVKGYFPEPVTVTWNSGSLSSGVHTFPAVLQSDLYTLSSSVTVPSSTWPSETVTCNVAHPASSTKVDKKIVPRDCTSKP

SEQ ID NO: 3213 - protein, 230 aa, Artificial Sequence
  Description of Artificial Sequence: Synthetic polypeptide
QVTLKESGPGILQPSQTLSLTCSFSGFSLSTSGMGVGWIRQPSGKGLEWLAHIWWDDVKRYSPALKSRLTISKDTSSSQLFLKIASVDTADTATYYCARIKSVITTGDYALDYWGQGTSVAVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCTSKP

SEQ ID NO: 3214 - protein, 124 aa, Artificial Sequence
  Description of Artificial Sequence: Synthetic polypeptide
EVQLLEQSGAEVKKPGESLKISCKVSGSRSTNYWIAWVRQMPGKGLEWMGIISPSDSTTKYSPAFQGQVTISADKSINTAYLQWSSLRASDTAIYYCAKSTIGVWDYYYYMDVWGEGTSVTISS

SEQ ID NO: 3215 - protein, 124 aa, Artificial Sequence
  Description of Artificial Sequence: Synthetic polypeptide
EVQLLEQSGAEVKKPGASVKVSCKASGYRFSNYAMHWVRQAPGQSLEWMGWINPVSGKTQFSQKFQGRVTITRDTSASTVYMEVTSLTSEDTAVYYCTRDLPGTWNFVDVFDIWGQGTMVTVSS

SEQ ID NO: 3216 - protein, 124 aa, Artificial Sequence
  Description of Artificial Sequence: Synthetic polypeptide
EVQLLEQSGAEVKKPGESLTISCQGSGDIFTNYWIGWVRQMPGKGLEWMGIIYPRNSDTKYSPSFQGLVTISADKSTNTAYLQWNSLGASDTAIYYCVRASYGNYNYFYNMDVWGRGTTVTISS

SEQ ID NO: 3217 - protein, 137 aa, Artificial Sequence
  Description of Artificial Sequence: Synthetic polypeptide
EVQLLEQSGPRLVKPSQTLSLTCSVSGASLTRGNYYWSWMRQPPGKGLEWIGTIHSRGRPAYNTSLASRVAMSVDASNNQFSLNLNSVTAADTAVYYCARVFQSKGGAVWAPTTEWTYSYYYYMDVWGRGTTVTVSS

SEQ ID NO: 3218 - protein, 110 aa, Artificial Sequence
  Description of Artificial Sequence: Synthetic polypeptide
ELTQPPSVSGALGQRVTIPCTGGSSNIGSSYHVHWYRQLPGTAPRLLIYADTRRPSGVPGRFSASKSGTSASLAITDLQAGDEADYYCQTYDSDLGGSVFGGGTRVTVLG

SEQ ID NO: 3219 - protein, 110 aa, Artificial Sequence; identical to SEQ ID NO: 3218
  Description of Artificial Sequence: Synthetic polypeptide

SEQ ID NO: 3220 - protein, 110 aa, Artificial Sequence
  Description of Artificial Sequence: Synthetic polypeptide
ELTQPPSVSGAPGQSVTIPCAGSSSNIGAAYDVHWYQQFPGTVPKLLIYSNSNRPSGVPARFSGSKSGTSGSLAITGLQAEDEAYYYCQSYDRSLNGVVFGGGTKLTVLG

SEQ ID NO: 3221 - protein, 110 aa, Artificial Sequence; identical to SEQ ID NO: 3218
  Description of Artificial Sequence: Synthetic polypeptide

SEQ ID NO: 3222 - protein, 110 aa, Artificial Sequence; identical to SEQ ID NO: 3220
  Description of Artificial Sequence: Synthetic polypeptide

SEQ ID NO: 3223 - protein, 109 aa, Artificial Sequence
  Description of Artificial Sequence: Synthetic polypeptide
MGKEWLERKLLIDVGVYLNRARPFLAWSANIGGTGTGTAAPRNGPKVIIYRNAQRPSGVPDRFSGSKSGTSASLAVSGLQSEDEADYCAAWDDSLNAWVFGGGTVTVLG

SEQ ID NO: 3224 - protein, 107 aa, Artificial Sequence
  Description of Artificial Sequence: Synthetic polypeptide
DIQMTQSPSSLSASIGDRVTVTCRASQDIGTYLHWYQQKPGKAPKLLIYAASSLRRGVPSRFSGSGSGTDFTLTISSLHGEDFATYYCQQSYTTMWTFGQGTIVESK

SEQ ID NO: 3225 - protein, 107 aa, Artificial Sequence
  Description of Artificial Sequence: Synthetic polypeptide
DIQMTQSPSSLSASVGDRVTITCRASQSISSYLNWYQQKPGQAPKLLIFAASSLQSGVPSRFSGSGSGTDFTLTLSSLQPEDFATYYCQQSYSTPYTFGQGTKVEIK

SEQ ID NO: 3226 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTTWTFGQGTKVEIK

SEQ ID NO: 3227 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSFSTPYTFGQGTKLEIK

SEQ ID NO: 3228 - protein, 108 aa, Artificial Sequence
  Description of Artificial Sequence: Synthetic polypeptide
DIQMTQSPASLSVSVGETVTITCRASENIYSNLAWYQQKQGKSPQLLVYAATNLADGVPSRFSGSGSGTQYSLKISSLQSEDFGSYYCQHFWGSPWTFGGGTKLEIKR

SEQ ID NO: 3229 - protein, 112 aa, Artificial Sequence
  Description of Artificial Sequence: Synthetic polypeptide
DVVMTQTPLSLSVTIGQPASISCKSSQSLLYRNGKIYLNWLQQRPGQAPKHLMSQVSKLDPGIPDRFSGSGSETDFTLKISRVEAEDLGVYYCLQGTHYPYTFGGGTKLEIK

SEQ ID NO: 3230 - protein, 108 aa, Artificial Sequence
  Description of Artificial Sequence: Synthetic polypeptide
DIQMTQSPASLSVSVGETVTITCRASEIIYSNLAWYQQKQGKSPQLLVYSATNLAEGVPSRFSGSGSGTQYSLKINSLQSEDFGSYYCQHFWGNPWTFGGGTKLEIKR

SEQ ID NO: 3231 - protein, 112 aa, Artificial Sequence
  Description of Artificial Sequence: Synthetic polypeptide
NIMMTQSPSSLAVSAGEKVTMSCKSSQSVLYSSNQKNYLAWYQQKPGQSPKLLIYWASARESGVPDRFTGSGSGTDFTLTINSVQTEDLAVYYCHQYLSSYTFGGGTKLEIK

SEQ ID NO: 3232 - protein, 112 aa, Artificial Sequence
  Description of Artificial Sequence: Synthetic polypeptide
AELQMTQSPSSLSASVGDRVTITCRASHKMYDYVSWYHQRPGEAPRLLIYAASTLQTGAPTRFSGSGSGTDFTLTIGGLQPEDFGTYYCQRAFGTQLTFGGGTKVEIKRTVA

SEQ ID NO: 3233 - protein, 112 aa, Artificial Sequence
  Description of Artificial Sequence: Synthetic polypeptide
AELTQSPSSLSASVGDRVTITCRASGDVGHYLGWFQQKPGQAPKRLIYAASNLQSGVPSRFSGSGSGTEFTLTISSLQPEDFATYYCLQHNSYPWTFGQGTKLEIKRTVAAP

SEQ ID NO: 3234 - protein, 212 aa, Artificial Sequence
  Description of Artificial Sequence: Synthetic polypeptide
DIQMTQSPASLSVSVGETVTITCRASENIYSNLVWYQQKQGKSPQVLVYAATNLPDGVPSRFSGSGSGTQYSLKINSLQSEDSGSYYCQHFWETPFTFGSGTKLEIKRADAAPTVSIFPPSSEKVLSGGASVVCFLNNFYPKDINVKWKIDGSERQNGVLNSWTDQDSKDSTYSMSSTLTLTKDEYERHNSYTCEATHKTSTSPIVKSFNRN

SEQ ID NO: 3235 - protein, 214 aa, Artificial Sequence
  Description of Artificial Sequence: Synthetic polypeptide
DIQMTQSPASLSVSVGETVTITCRASEIIYSNLAWYQQKQGKSPQLLVYSATNLAEGVPSRFSGSGSGTQYSLKINSLQSEDFGSYYCQHFWGNPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3236 - protein, 121 aa, Artificial Sequence
  Description of Artificial Sequence: Synthetic polypeptide
QVTLRSLVLRWGNPHRPSRGPAPSLGSHSALVEGGVGWIRQPPGKALEWLALIYWNDDKRYSPSLKSRLTITKDTSKNQVVLTMTNMDPVDTATYYCAHRRLPAAVRIFNIGQGTLVTVSS

SEQ ID NO: 3237 - protein, 242 aa, Artificial Sequence
  Description of Artificial Sequence: Synthetic polypeptide
MGKEVVLERKLLIPVGWLNRARPFLAWSAIGGTGTGTAAPRNGPKVIIYRAQRPSGVPDRFSGSKSGTSASLAVSGLQSEDEADYYCAAWDDSLNAWVFGGGTKVTVLGGGGGSGGGGSGGGGSQVTLRSLVLRWGNPHRPSRGPAPSLGSHSALVEGGVGWIRQPPGALEWLALIYWNDDRYSPSLKSRLTITKDTSKNQVVLTMTNMDPVDTATYYCAHRRLPAAVRIFIGQGTLVTVSS

SEQ ID NO: 3238 - protein, 117 aa, Artificial Sequence
  Description of Artificial Sequence: Synthetic polypeptide
EVQLEESGGDLVQPGGSLTLSCAASGFTFSRYWMSWVRQAPGKGPEWVASIKKDGSETFYADSVKGRFIISRDIAKTSLYLQMNSLRADDTAVYYCLRAWYSSAYDFWGQGTLVTVS

SEQ ID NO: 3239 - protein, 108 aa, Artificial Sequence
  Description of Artificial Sequence: Synthetic polypeptide
ELELTQSPSSLSASVGDRVTITCRASQSISNYLNWYQQKPGKAPNLLIYYASTLQSGVPSRFSGSGSGTDFTLTISSLQPEDFATYYCQHGYGAIAFGQGTRLEIKRT

SEQ ID NO: 3240 - protein, 148 aa, Artificial Sequence
  Description of Artificial Sequence: Synthetic polypeptide
EVQLEQSGAEVKKPGSSVKVSCKISGGTFSRHPISWVRQAPGQGLLWMGAIILRAGTTKYEQRFQGRITITADESTGTAYMELHSLTSEDTGLYFCATDRMGTFDELLFDSWGQGTLVTVSSASTELQMTQSPASLSASVGDRVTITC

SEQ ID NO: 3241 - protein, 109 aa, Artificial Sequence
  Description of Artificial Sequence: Synthetic polypeptide
ELQMTQSPASLSASVGDRVTITCRASQGIRNNLGWYQQKPGKPPKLLIYAASTLQSGVPSRFSGSGSGTGFTLTISSLQPEDFATYYCLQDYDFPLTFGGGTKVEIKRT

SEQ ID NO: 3242 - protein, 106 aa, Artificial Sequence
  Description of Artificial Sequence: Synthetic polypeptide
EVQLEESGGVLVKPGGSLRLSCAASGFTFSSHAMHWVRQAPGKGLEWVAIINSGHRADYADSVKDRFTISRDNSKNTLYLQMDSLRPEDTAFYYCAREGDQQDVAD

SEQ ID NO: 3243 - protein, 107 aa, Artificial Sequence
  Description of Artificial Sequence: Synthetic polypeptide
ELTQSPSTLSASVGDRVTITCRASEDIMSYLAWYQQKPAKAPRLLIYYASSLQSGVPSRFSGSGSGTEFTLTISSLQPEDFATYYCQQLHTFPITFGPGTRLDIKRT

SEQ ID NO: 3244 - protein, 132 aa, Artificial Sequence
  Description of Artificial Sequence: Synthetic polypeptide
LEEVQLVESGPGLVKPSETLSLTCAVSGASIRRANWWGWIRQAPGKGLEWLGSIFINAGTIYNPSLTGRVTVSADTSKNLFSLKLGSVTAADTAVYYCVKSYGDGDDNYNSFYYYMDVWGKGTSVIVSSAST

SEQ ID NO: 3245 - protein, 110 aa, Artificial Sequence
  Description of Artificial Sequence: Synthetic polypeptide
DVVMTQSPSSLSASVGDRVTITCRASQDIRNNLAWYQHKPGKAPKLLIYYASKLQSGVPLRFSGSGSGTDYTLFISSLQPEDFATYYCQQYKTDTPYSFGQGTKVDIKRT

SEQ ID NO: 3246 - protein, 118 aa, Artificial Sequence
  Description of Artificial Sequence: Synthetic polypeptide
EVQLEESGGGLVQPGGSLRVSCAASGFPFNGYWIHWVRQAPGKGLEWVSRVNSDGRITNFADSVMGRFTMSRDNAKSTVYLQMNSLRAEDTAMYYCSRGGYTGYPEGHWGQGTLVTVS

SEQ ID NO: 3247 - protein, 109 aa, Artificial Sequence
  Description of Artificial Sequence: Synthetic polypeptide
ELQMTQSPSSLSAAVGDSVTITCRASQGISIHLAWYQQKPGKVPNLLIYAASTLQSGVPSRFSGSGSGTDFTLTINSLQPEVFATYYCQKYDSAPFTFGPGTKVDIKRT

SEQ ID NO: 3248 - protein, 124 aa, Artificial Sequence
  Description of Artificial Sequence: Synthetic polypeptide
EVQLEQSGGGLIKPGGSLRLSCAASGFTFTKYVMHWVRQAPEKGLQWVSAIGGSGGSAWYADSVKGRFTISRDNSKNTLYLQMNSLRAEDTAVYYCARDHARYSGYNSPHEVDSWGQGTLVAVS

SEQ ID NO: 3249 - protein, 109 aa, Artificial Sequence
  Description of Artificial Sequence: Synthetic polypeptide
ELELTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKRT

SEQ ID NO: 3250 - protein, 129 aa, Artificial Sequence
  Description of Artificial Sequence: Synthetic polypeptide
EVQLVETGGSLVQPGGSLRLSCAASGFSVSIYHMSWVRQAPGKGLEWVSLLYSGGSTYYADSVKGRFTISRDNSKNTLYLQMNSLRAEDTAVYYCARDYSGSWVGDEARSYYYYYYMDVWGKGTTVTVS

SEQ ID NO: 3251 - protein, 109 aa, Artificial Sequence
  Description of Artificial Sequence: Synthetic polypeptide
ELQVTQSPSSLSASVGDRVTITCQASQDISYYLNWYQQRPGKVPKLLIYSASYLHSGVPSRFSGSGSGTDFTLTISSLQPEDVATYYCQRTYNAPYTFGQGTKVEIKRT

SEQ ID NO: 3252 - protein, 127 aa, Artificial Sequence
  Description of Artificial Sequence: Synthetic polypeptide
EVQLEQSGGGLVKPGGSLRLSCAGSGFSFSAHTINWVRQAPGKGLEWVGFIRSQAQGGTREYAASVKGRIILSRDDSENSAYLQMNSLNTGDTAVYYCARDSSRGYYSYYLDVWGKGTTVTVSSAST

SEQ ID NO: 3253 - protein, 107 aa, Artificial Sequence
  Description of Artificial Sequence: Synthetic polypeptide
ELTQSPSSLSASVGDRVTITCRASQGISNRLNWYQQKPGKAPKLLIYDASSLESGVPSRFSGSGSGTDFTLTISSQQPEDFATYYCQQFNSYPLTFGGGTKVEIKRT

SEQ ID NO: 3254 - protein, 115 aa, Artificial Sequence
  Description of Artificial Sequence: Synthetic polypeptide
EVQLEESGGGLVKPGGSLRLSCAASGFTFSHYVMYWVRQAPEKGLEWVSTISGSGSSTWYPDSVKGRFTVSRDNSKNTLYLQMNSLRGDDTAVYYCARLQGQLVYWGLGTLVTVS

SEQ ID NO: 3255 - protein, 110 aa, Artificial Sequence
  Description of Artificial Sequence: Synthetic polypeptide
ELQMTQSPSTLSASVGDRVTITCRASQGISSWLAWYQQKPGRAPKLLIYKSSTLESGVPSRFSGSGSGTEFTLTISSLQPDDFATYFCQQYSSNPPLTFGGGTKVEIKRT

SEQ ID NO: 3256 - protein, 131 aa, Artificial Sequence
  Description of Artificial Sequence: Synthetic polypeptide
QVQLQESGGGLVQPGGSLRLSCAASESTPSINTMGWYRQAPGKERELVATITSGGMTNYADSVKGRFTISRDNGKNTVYLQMNSLEPGDTAVYYCNLKRRDLQARFGGYWGQGTQVTVSSEPKTQTTTSGR

SEQ ID NO: 3257 - protein, 132 aa, Artificial Sequence
  Description of Artificial Sequence: Synthetic polypeptide
QVKLQQSGGGLVQPGGSLRLSCAASESTISINTLGWYRQAPGNQRELVATITTGGTTNYADSVKGRFTISRDNAKNTVYLQMNNLEPGDTAVYYCNLKRRDLQSRFGGYWGQGTQVTVSSEPQDTKTTTSGR

SEQ ID NO: 3258 - protein, 131 aa, Artificial Sequence
  Description of Artificial Sequence: Synthetic polypeptide
QVQLQQSGGGLVQPGGSLRLSCVASESTVSINIMGWYRQAPGKQRELVATITTGGTTNYADSVKGRFTISRDNAKNTVYLQMNSLEPEDTAVYYCNLKRRDLQARFGGYWGQGTQVTVSSEPKTPKPTSGR

SEQ ID NO: 3259 - protein, 131 aa, Artificial Sequence
  Description of Artificial Sequence: Synthetic polypeptide
QVKLQQSGGGLVQPGGSLRLSCAASESTPSINTMGWYRQAPGKERELVATITSGGMTNYADSVKGRFTISRDNGKNTVYLQMNSLEPGDTAVYYCNLKRRDLQARFGGYWGQGTQVTVSSEPKTPKPQSGR

SEQ ID NO: 3260 - protein, 132 aa, Artificial Sequence
  Description of Artificial Sequence: Synthetic polypeptide
QVKLQQSGGGLVQPGGSLRLSCAASGFTFRNYAMSWVRQAPGKGLEWVSAIAAGGAVTKYADSVKGRFTISRDNARDTLYLQMNSLKPEDTAVYYCAKPRDFWYSPEFDFRGQGTQVTVSSEPKNQNQTSGR

SEQ ID NO: 3261 - protein, 133 aa, Artificial Sequence
  Description of Artificial Sequence: Synthetic polypeptide
QVQLQQSGGGLVQAGDSLTISCASSLFTFSTSTMGWFRQAPGKEREFVAAIKSSGSSMYYADSVQGRFTISRDNAKKTVTLQMNSLKPEDTAVYYCAKGVYGSRRSADFGSWGQGTQVTVSSEPKTPKPQSGR

SEQ ID NO: 3262 - protein, 133 aa, Artificial Sequence
  Description of Artificial Sequence: Synthetic polypeptide
QVQLQQSGGGLVQAGDSLRISCAASLFTFSTSTMGWFRQAPGKEREFVAAIRSTGDSMYYADSVQGRFTISRDNAKKMVYLQMNNLKPEDTAVYYCAKGVYGSRRSADFGSWGQGTQVTVSSEPKTPKPQSGR

SEQ ID NO: 3263 - protein, 133 aa, Artificial Sequence
  Description of Artificial Sequence: Synthetic polypeptide
DVQLQASGGGLVQAGGSLRISCTADGYTFSTSTMGWFRQAPGKEREFVAAIKSDGSIMYYADSVAGRFIISRDNAKKMVFLQMDRLKPEDTAVYYCAKGVYGSRRSADFGWWGQGTQVTVSSEPKTPKPQSGR

SEQ ID NO: 3264 - protein, 134 aa, Artificial Sequence
  Description of Artificial Sequence: Synthetic polypeptide
QVKLQESGGGLVQAGESLRLSCAASGSNFSINGVGWYRQAPGKQRELVAGITNGGYTSYADSVKGRFTISTDNAKNTVYLQMNSLRPEDTAVYYCNANFQIHRSGADYVRNYWGQGTQVTVSAEPRTKTTTSGR

SEQ ID NO: 3265 - protein, 134 aa, Artificial Sequence
  Description of Artificial Sequence: Synthetic polypeptide
QVKLQQSGGGLVQAGGSLRLSCAASGNFFTLNGVAWYRQAPGKQRELVAGITSGGWTNYADSVKGRFTISADNAKNTVYLQMNSLRPEDTAVYYCNANLQIHRDSSGDVRNVWGQGTQVTVSSEPKTPKPQSGR

SEQ ID NO: 3266 - protein, 136 aa, Artificial Sequence
  Description of Artificial Sequence: Synthetic polypeptide
DVQLQASGGGLVQAGGSLRLSCAASGSFFSINGVGWYRQAPGKQRELVAGITNGGFTNYADSVKGRFTISRDNAKNTVYLQMNSLKPEDTAVYYCNANLQISRSEDGAYVVRNYWGQGTQITVSSEPKTPKPQSGR

SEQ ID NO: 3267 - protein, 134 aa, Artificial Sequence
  Description of Artificial Sequence: Synthetic polypeptide
DVQLQASGGGLVQAGGSLRLSCAASGSGFSINGVGWYRQTPGRQRELVAGITIGGYTNYADSVKGRFTISSDNAKNTVYLQMNSLKPEDTAVYYCNANLQFYRGGGSDVKNYWGQGTQVTVSSEPKTPKPQSGR

SEQ ID NO: 3268 - protein, 135 aa, Artificial Sequence
  Description of Artificial Sequence: Synthetic polypeptide
QVQLQESGGGLVQAGGSLRLSCAASGLTFSSYAMGWFHQAPGKEREFVAAINWSGRDTYYADSVKGRFTISRDNRKNTVYLQMNSLKPEDTAVYYCAAAEFFSSGDPLPGMDYWGKGTLVTVSSEPKTQNHNSGR

SEQ ID NO: 3269 - protein, 135 aa, Artificial Sequence
  Description of Artificial Sequence: Synthetic polypeptide
QVKLQQSGGGLVQAGGSLRLSCAASGLTFSSYAMGWFRQAPGKEREFVAAINWSGRDTYYADSVKGRFTISRDNAKNTVYLQTNSLKPEDTAVYYCAAAEFLPTQRSPREYDYWGLGTQVTVSSEPKTPKPQSGR

SEQ ID NO: 3270 - protein, 136 aa, Artificial Sequence
  Description of Artificial Sequence: Synthetic polypeptide
QVKLQQSGGGLVQAGGSLRLSCAASGYAFNTYTMAWFRQAPGKEREFVALVGMKVDGKIYADSVKGRFTISRDNEQKTVLLEMNHLEPEDTAIYYCAASRRFWTAALNGADYPYWGQGTQVTVSSEPKTPKPQSGR

SEQ ID NO: 3271 - protein, 129 aa, Artificial Sequence
  Description of Artificial Sequence: Synthetic polypeptide
QVKLQQSGGGLVQAGGSLRLSCAASGIVFSFNAMGWYRVPPGKQRELVADILKSGGTNVVDSVKGRFAISRDSAQNTLYLQMNRLKPEDTAVYYCNARDWSDGFDEYWGQGTQVTVSSEPKTPKPQSGR

SEQ ID NO: 3272 - protein, 135 aa, Artificial Sequence
  Description of Artificial Sequence: Synthetic polypeptide
QVQLQQSGGGLVQAGGSLRLSCSASGRTFSNYVMGWFRQAPGKEREFVATISASGGSTYCADSVEGRFTISRDNAKNTAYLQMNNLEPEDTAVYYCASGPRANASIRRSGYNYWGQGTQVTVSSEPKTPKPQSGR

SEQ ID NO: 3273 - protein, 136 aa, Artificial Sequence
  Description of Artificial Sequence: Synthetic polypeptide
QVQLQQSGGGLVQAGGSLRLSCAASGLAFSSYAITWLRQAPGTEREFVALISGSGSSTYYADSVKGRFTISRNNAKNTVYLQMNSLKPEDTAVYYCTASEFLLHPPPPNQKYDYWGQGTQVTVSSEPKTPKHTSGR

SEQ ID NO: 3274 - protein, 135 aa, Artificial Sequence
  Description of Artificial Sequence: Synthetic polypeptide
QVQLQQSGGGLVRAGGSLRLSCSASGRTFGNEVMGWFRQAPGKEREFVAAINWSSGNTYYRDSVKGRFTISRDNAKNTVYLQMNSLEPEDTAVYYCAARSRPAISTRRPDYFAWGQGTQVTVSSEPKTPKPQSGR

SEQ ID NO: 3275 - protein, 133 aa, Artificial Sequence
  Description of Artificial Sequence: Synthetic polypeptide
QVQLQQSGGGLVQAGGSLRLSCTASGRIDRTYTVSWFRQGPGKEREFVATISWDGSIYYDNAVEGRFSISGDNAKTTVALQMNSLKPEDTAVYYCAARRRVFSRAAAAYNYWGQGTQVTVSSEPKTPKPQSGR

SEQ ID NO: 3276 - protein, 124 aa, Artificial Sequence
  Description of Artificial Sequence: Synthetic polypeptide
QVKLQQSGGGLVQPGGSLRLTCAASGFPFSTYAIRWVRRPPGKGLEWVSTIHPDFTTNYADSVSRRFTISRDNAKNTVYLQMNSLKPEDTAVYYCSRGVSGERGQGTQVTVSSEPKTPKPHSGR

SEQ ID NO: 3277 - protein, 132 aa, Artificial Sequence
  Description of Artificial Sequence: Synthetic polypeptide
QVQLQQSGGGLVQPGGSLRLSCAASGSIFSIHTMGWYRQAPGKQRELVTTITTGGTTNYADSVKGRFTISRDDAKNTVYLQMNNLKPEDTAVYYCYALIQTASTTWYRQYWGQGTQVTVSSEPKTQNHNSGR

SEQ ID NO: 3278 - protein, 126 aa, Artificial Sequence
  Description of Artificial Sequence: Synthetic polypeptide
QVKLQESGGGLVQPGGSLRLSCTASRSIFTRAMAWYRQAPGKQRELVAAIDSGDRTHYADSVKGRFTISRNNAKDTLYLQMNSLKSEDTAVYYCNANLGALLDYWGQGTQVTVSSEPKTQTTTSGR

SEQ ID NO: 3279 - protein, 129 aa, Artificial Sequence
  Description of Artificial Sequence: Synthetic polypeptide
QVKLQESGGGLVQAGGSLRLSCAASGFTFATYAMAWYRQAPGKQRELVASISNFGSTAYGDSVKGRFTISRDNAKNTVYLEMNSLKSEDTAVYYCKRVRDVIGRPELWGQGTQVTVSSEPKTPKPHSGR

SEQ ID NO: 3280 - protein, 132 aa, Artificial Sequence
  Description of Artificial Sequence: Synthetic polypeptide
QVKLQESGGGLVQPGGSLRLSCLPSINIFSLAAMGWYRQAPGKQRELVASISSGGTANYADSYADSVKGRFTISRDIAKNTVDLQMNSLKPEDTAVYYCKVDSYTYGTDIWGKGVLVTVSSEPQDTKTTSGR

SEQ ID NO: 3281 - protein, 140 aa, Artificial Sequence
  Description of Artificial Sequence: Synthetic polypeptide
QVKLQQSGGGLVQAGGSLRLSCAASGTFSRYAMGWFRQAPGKEREFVAAINWTGGSTYYADSVKGRFTISGDNAKNTVYLQMNSLKPGDTAVYYCAAEVHPGDYGLTYMQSQYEYDYWGQGTQVTVSSEPKTPKPTTSGR

SEQ ID NO: 3282 - protein, 131 aa, Artificial Sequence
  Description of Artificial Sequence: Synthetic polypeptide
DVQLQASGGGLVQAGGSLRLSCAASTSRFSSYAMGWSRQAPGKQRELVASISSSGLTTNYADSVKGRFTISRDNAKNTVYLQMNSLKPEDTAVYYCKADGRRYSLNEYWGQGTQVTVSSEPKTPKPQPSGR

SEQ ID NO: 3283 - protein, 133 aa, Artificial Sequence
  Description of Artificial Sequence: Synthetic polypeptide
DVQLQASGGGLVQAGGSLRLSCAASGSTISSYAMAWYRQAPGKRRELVAHISSGGSTNYADSVKGRFTISRDNAKNTVYLQMNSLKPEDTAVYYCNIYYGGDYYYTGVKPNPWGQGTQVTVSSAHHSEDPRGR

SEQ ID NO: 3284 - protein, 137 aa, Artificial Sequence
  Description of Artificial Sequence: Synthetic polypeptide
QVKLQESGGGWVQAGGSLRLSCAASALTASITTMGWFRQTPEKEREFLAAINWTGDYKYYADSVKGRFTISRDNAKNTVDLQMNQLKPEDTAVYYCAASKIRNDIYLNDYTWYQYWGQGTQVTVSSEPKTPKPQSGR

SEQ ID NO: 3285 - protein, 143 aa, Artificial Sequence
  Description of Artificial Sequence: Synthetic polypeptide
DVQLQASGGGLVQAGGSLRLSCVASARTFSSYAMGWFRQAPGKEREFVAAISWSGASTDYADSVKGRFTISRDNAKKTVYLQMNTLKPEDTAVYYCAAHHITPTGSYYYSEPLPVDMVYDYWGQGTQVTVSSEPKTKTTTSGR

SEQ ID NO: 3286 - protein, 123 aa, Artificial Sequence
  Description of Artificial Sequence: Synthetic polypeptide
QVQLQDSGGGLVQAGDRLSLSCAASGRTFSSYDMAWFRQAPGKEREFVAAITTSEGTWYGDAGKGRFTIARVNAKNTVYLHMNRLKPEDTAVYYCAASNQGGSLQISTNYNYWGQGTQVTVSS

SEQ ID NO: 3287 - protein, 123 aa, Artificial Sequence
  Description of Artificial Sequence: Synthetic polypeptide
QVQLQESGGGLVQAGDSLRLSCAASGRTFSSYAMGWFRQAPGKEREFVAAVSSSNSPWYGDSIKGRSTIHRDNAKNTVYLYMNNLKPEDTAVYYCAADLEGERLGESSEYDYWGQGTQVTVSS

SEQ ID NO: 3288 - protein, 127 aa, Artificial Sequence
  Description of Artificial Sequence: Synthetic polypeptide
QVQLQESGGGLVQPGGSLRLSCAASGFTFKYYAMSWVRQAPGKGLEWVSYINDNGGYTDYSDSVKGRFTISRDNAKNTLYLHMNRLKPEDTAVYFCAKWDTDAVSSSRYKTHNGDIRGPGTQVTVSS

SEQ ID NO: 3289 - protein, 123 aa, Artificial Sequence
  Description of Artificial Sequence: Synthetic polypeptide
QVQLQESGGGLVQPGGSLRLSCAASGRTFSSYAMGWFRQAPGKERQFVAAVSSSDSPWYGDSMKGRSTIHRDNAKNTVYLYMNNLKPEDTAVYYCAADLEGERLGESSEYDYWGQGTQVTVSS

SEQ ID NO: 3290 - protein, 125 aa, Artificial Sequence
  Description of Artificial Sequence: Synthetic polypeptide
QVQLQESGGGLVQAGDSLRLSCAASGGALYDMAWFRQAPGKEREFVAVISYDGSATSYRDSVKGRFTISRENAKNMARNMAYLQMNALKPEDTAVYYCAAKGPTGTLHTSGYRIWGQGTQVTVSS

SEQ ID NO: 3291 - protein, 125 aa, Artificial Sequence; identical to SEQ ID NO: 3290
  Description of Artificial Sequence: Synthetic polypeptide

SEQ ID NO: 3292 - protein, 126 aa, Artificial Sequence
  Description of Artificial Sequence: Synthetic polypeptide
QVQLQESGGGLVRPGGSLRLTCATSGFSLDYYPIAWFRQAPGKEREGLSCISSSDGGAYYGDAVKGRFTMSRDSAENTVYLHMNSLKPEDTAVYYCATSKRYWRNCDVTDYDYHYWGQGTQVTVSS

SEQ ID NO: 3293 - protein, 126 aa, Artificial Sequence
  Description of Artificial Sequence: Synthetic polypeptide
QVQLQESGGGLVQPGGSLRLSCATSGFSLDYYPIAWFRQAPGKEREGLSCVSSSDGGTYYGDAAKGRFTMSRDSAENTVTLHMNSLKPEDTAVYYCATSKRYWRNCDVTDYDYHYWGQGTQVTVSS

SEQ ID NO: 3294 - protein, 126 aa, Artificial Sequence
  Description of Artificial Sequence: Synthetic polypeptide
QVQLQESGGGLVQAGDSLTLSCAVSGGTLSMFSMGWFRQAPGLEREFVAIINDRESIRRYQDSVKGRFTISKDNAKNLVYLQMNNLKPVDTAVYYCAADTTYPAVAPTSVGQYDYWGQGTQVTVSS

SEQ ID NO: 3295 - protein, 125 aa, Artificial Sequence
  Description of Artificial Sequence: Synthetic polypeptide
QVQVQKSEGGLVQPGGSLRLSCAVSGRTDSISAMGWFRQAPGKEREFVVAIRWIEGGTWYGDPAAGRFTIARDIAKNTGYLQMNRLNPDDTAVYFCAAAKFGPSKLQFSQGYDYWGQGTQVTVSS

SEQ ID NO: 3296 - protein, 118 aa, Artificial Sequence
  Description of Artificial Sequence: Synthetic polypeptide
QVKLAGTLGGLVQLGDSLQLSCVASGRTDVMGWFRQAPGKEREFAAAITGSDGTFYGDAGRGRFTIARDNTKNTVYLNLNRLKPEDTAVYYCAADGSPLQIASTYKYWGQGTQVTVSS

SEQ ID NO: 3297 - protein, 124 aa, Artificial Sequence
  Description of Artificial Sequence: Synthetic polypeptide
QVQLQDSGGGLVQAGTSLRLSCVAKGGLYGLGWFRQAPGKEREFVAAISGSGGSTYYGDSVRGRFTISRDNTKNTMYLQMNSLKPEDTAIYFCAARTQYSASDYWWQQGEYGYWGQGTQVTVSS

SEQ ID NO: 3298 - protein, 127 aa, Artificial Sequence
  Description of Artificial Sequence: Synthetic polypeptide
QVQLQESGGGLVQPGGSLRLSCEASGFTFSYYAMSWVRQAPGKGLEWVSYINSDGGYTSYADSVKGRFIISRDNAKNILYLHMNSLKPEDTAVYFCAKWRTDAVSSSRYKTNDYEYRGPGTQVTVSS

SEQ ID NO: 3299 - protein, 125 aa, Artificial Sequence
  Description of Artificial Sequence: Synthetic polypeptide
QVQLQKSGGGLVQAGGSLRLSCARGSGTFSPYAMGWFRQAPGEERQFVAAITWSSDSPWYGDSAKGRCTIARDITKNTVYLNIFGLKPEDTAVYYCAESSGATYGLALPSAYEHWGRGTQVTASS

SEQ ID NO: 3300 - protein, 127 aa, Artificial Sequence
  Description of Artificial Sequence: Synthetic polypeptide
QVQGAGLWGGLVQLGGSLRLSCAASGFTFGYYAMSWVRQAPGKGLEWVSYINDNGGYTAYTDPVKGRFTISRDNAKNILYLHMNNLKPEDTAVYFCAKWGTDAVSSSRYKSHDYDSRGPGTQVTVSS

SEQ ID NO: 3301 - protein, 125 aa, Artificial Sequence
  Description of Artificial Sequence: Synthetic polypeptide
QVQLQESGEGLVQAGASLKLSCEASLGGLYGMGWFRQAPGKEREFVAAISGSGGTTYYEDSVRGRFTISRDNAKSTVFLQMNNLKPEDTAVYYCAARTSYSASNAWNQLREYGYWGQGTQVTVSS

SEQ ID NO: 3302 - protein, 122 aa, Artificial Sequence
  Description of Artificial Sequence: Synthetic polypeptide
QVQLQESGGGLVQAGGSLRLSCAGVGRTISPYNMGWFRQALGKERDFVAAIRWSGSDTNYADSVKGRFTISRDNAENTVYLQMRNLNPEDTAVYYCAAGGDVFGSALTYHHWGQGTQVTVSS

SEQ ID NO: 3303 - protein, 119 aa, Artificial Sequence
  Description of Artificial Sequence: Synthetic polypeptide
QVQLQESGGGLVQPGGSLRLSCAASGSIRSINAMGWYRQAPGKQREFVARITTGGTIGYADSVKGRFTISRDNAKNTMYLQMNSLKPEDTAVYYCNADIGTWSSPYYYWGQGTQVTVSS

SEQ ID NO: 3304 - protein, 122 aa, Artificial Sequence
  Description of Artificial Sequence: Synthetic polypeptide
QVQLQDSGGGLVQAGGSLRLSCAGVGRTISPYNMGWFRQALGKERDFVAAIRWSGSDTNYADSVKGRFTISRDNARNTVYLQMNNLNPEDTAVYYCAAGGDVFGSALTYHHWGQGTQVTVSS

SEQ ID NO: 3305 - protein, 119 aa, Artificial Sequence
  Description of Artificial Sequence: Synthetic polypeptide
QVQLQESGGGLVQPGGSLRLSCAASGSIRSINVMGWYRQAPGKQRELVALITTGGSPSYVDSVKGRFTISRDNAKSTIYLQMDSLKPEDTAVYYCNADIGTWSSPFYYWGQGTQVTVSS

SEQ ID NO: 3306 - protein, 122 aa, Artificial Sequence
  Description of Artificial Sequence: Synthetic polypeptide
QVQLQESGGGLVQAGGSLRLSCEGVGRSISPYNMGWFRQAPGKERDFVAAIRWSGSDTNYADSVKGRFTISRDNARNTVYLHMNSLNPEDTAVYYCAAGGDVSGSALSYHYWGQGTQVTVSS

SEQ ID NO: 3307 - protein, 397 aa, Artificial Sequence
  Description of Artificial Sequence: Synthetic polypeptide
MDVLYSISRTLKDARDKIVEGTLYSNVSDLIQQFNQMLVTMNGNEFQTGGIGNLPLRNWNFDFGLLGTTLLNLDANYVESARTTIDYFVDFIDNVCMDEMMRESQRNGIAPQSDALRKLSGVKFRRINFNNSSEYIENWNLQNRRQRTGFTFHKPNIFPYSASFTLNRSQPQHDNLMGTMWLNAGSEIQVAGFDYSCAINAPANIQQFEHIVQLRRVLTTATITLLPDAERFSFPRVINSADGATTWYFNPVILRPNNVEVEFLLNGQVINTYQARFGTIVARNFDTIRLSFQLMRPPNMTPAVTALFPNAQPFEHHATVGLTLRIDSAICESVLADASETMLANVTSVRQEYAIPVGPVFPPGMNWTDLITNYSPSREDNLQRVFTVASIRSMLVK

SEQ ID NO: 3308 - protein, 397 aa, Artificial Sequence
  Description of Artificial Sequence: Synthetic polypeptide
MEVLYSLSKTLKDARDRIVEGTLYSNVSDLIQQFNQMIVTMNGNDFQTGGIGNLPIRNWTFDFGLLGTTLLNLDANYVENARTTIEYFIDFIDNVCMDEMARESQRNGVAPQSEALRKLSGIKFKRINFDNSSEYIENWNLQNKRQRTGFVFHKPNIFPYSASFTLNRSQPMHDNLMGTMWLNAGSEIQVAGFDYSCAINAPANIQQFEHIVQLRRALTTATITLLPDAERFSFPRVINSADGATTWFFNPVILRPNNVEVEFLLNGQIINTYQARFGTIIARNFDTIRLSFQLMRPPNMTPVVNALFPQAQPFQHHATVGLTLRIESAVCESVLADANETLLANVTAVRQEYAIPVGPVFPPGMNWTELITNYSPSREDNLQRVFTVASIRSMLIK

SEQ ID NO: 3309 - protein, 223 aa, Artificial Sequence
  Description of Artificial Sequence: Synthetic polypeptide
EFQLVESGAEVKKPGASVKVSCKASGYSFTSYYVHWVREAPGEGLEWMGMINPSDGSTYYAQRFQPRVTMTRDTSTTTVFMEMSGLRSEDTAVYYCARGVVGATNEIDFWGQGTTVTVSSASFKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3310 - protein, 213 aa, Artificial Sequence
  Description of Artificial Sequence: Synthetic polypeptide
DIRLTQSPSSLSASVGDRVTITCRASQSISNYLNWYQKKPGQAPKLLIYAATSLQSGVPSRFSGSGSGTDFTLTISSVQPEDFATYYCQKTLRTWTFGQGTKVEIKRTAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3311 - protein, 220 aa, Artificial Sequence
  Description of Artificial Sequence: Synthetic polypeptide
QVQLVQSGGGVVQPGRSLRLSCEVSGITFKGYPMHWVRQAPGKGLEWVAVISNDGRNEDYADSVKGRFTISRDNSNNTLYLQMNSLTAEDTALYFCARSTGRRYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKTVERK

SEQ ID NO: 3312 - protein, 222 aa, Artificial Sequence
  Description of Artificial Sequence: Synthetic polypeptide
QVQLVQSGAEVKKPGASVKVSCKASGYTFNIHYIHWVRQAPGQGLEWMGIIDSDGGRTIYAQKFHGRITMTTDRSTTTVYLELSALRSEDTAVYYCARDGFGGRTWRLDWWGPGTVVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKTVERK

SEQ ID NO: 3313 - protein, 226 aa, Artificial Sequence
  Description of Artificial Sequence: Synthetic polypeptide
QVQLVQSGAEVKKPGASVKMSCTLSGTTFTRYGISWLRQAPGQGPEWMGWINPYNGDTNLAQKFQGRLSMTKDTSTSTAYMELRSLTSDDTAVYYCAREHSSAYSMRRKGVFHYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERK

SEQ ID NO: 3314 - protein, 220 aa, Artificial Sequence
  Description of Artificial Sequence: Synthetic polypeptide
QVQLQQSGPGLVKPSETLSLTCTVSGGSINNYYWSWIRQPAGKGLEWIGRIYSSGSTNYNPSLKSRVTMSVDTSKNQFSLKLSSVTAADTAVYYCAREVTHFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPV

SEQ ID NO: 3315 - protein, 226 aa, Artificial Sequence
  Description of Artificial Sequence: Synthetic polypeptide
QVQLVQSGGGVVQPGRSLRLSCATSEFTFSSHAMHWVRQAPGKGLEWVAVIWYDGVNTYYADSVKGRFTISRDNSKNTLYLQMNSLRAEDTAVYYCAREGLRFLEHIRGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKKIVPRD

SEQ ID NO: 3316 - protein, 221 aa, Artificial Sequence
  Description of Artificial Sequence: Synthetic polypeptide
EVQLVESGGGLVKPGGSLRLSCAASGFTFSSYNMNWVRQAPGKGLEWVASISHSSSYMFHADSLKGRFTISRDNAKNSLYLHMNSLRAEDMAVYYCARDGSRGWYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKKIVPRD

SEQ ID NO: 3317 - protein, 223 aa, Artificial Sequence
  Description of Artificial Sequence: Synthetic polypeptide
QVQLVESGGGLVQPGGSLRLSCAASGFTFSTYGMNWVRQAPGKGLEWISFISSSSSTVYYADSVKGRFTMSRDNAKNSLYLQMNSLRDEDTAVYYCARAHYDWNFDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKKIVPRD

SEQ ID NO: 3318 - protein, 219 aa, Artificial Sequence
  Description of Artificial Sequence: Synthetic polypeptide
DIVMTQSPLSLPVTPGEPASISCRSSQSLLHSNGFNFLDWYLRKPGQSPQLLIYLGSNRASGVPDRFSGSGSGTDFTLKISRVEAEDIGVYYCMQALESLPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3319 - protein, 220 aa, Artificial Sequence
  Description of Artificial Sequence: Synthetic polypeptide
DIELTQSPDSLAVSLGERATINCKSSQSVFYNSINKNFLAWYQQRPGQPPKLLIYWASTRASGVPDRFSGSGSGTDFTLTISSLQAEDVAVYYCQQYYNTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3320 - protein, 214 aa, Artificial Sequence
  Description of Artificial Sequence: Synthetic polypeptide
EIVLTQSPATLSVSPGERATLSCRASQSVSSNLAWYQQKPGQAPRLLIYGASTRATGIPARFNGGGSGTDFTLSISSPQSENFAVYHCQHYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3321 - protein, 214 aa, Artificial Sequence
  Description of Artificial Sequence: Synthetic polypeptide
EIVMTQSPATLSMSPGERATLSCRASQSISSNFAWYQQKPGQSPRLLIYGASTRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3322 - protein, 214 aa, Artificial Sequence
  Description of Artificial Sequence: Synthetic polypeptide
DIVLTQSPSSLSASVGDRVTITCRSSQSISSYLNWYQQKPGKAPKLLIYAASSLQSGVPSRFSGSGSGTDFTLTISSLQPEDLATYYCQQSYSIPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3323 - protein, 215 aa, Artificial Sequence
  Description of Artificial Sequence: Synthetic polypeptide
AIQMTQSPSFLSASVGDRVTITCRASQGISSYLAWYQQKPGKAPKLLIYAASTLQSGVPSRFSGSGSGTEFTLTISSLQPEDFATYYCQQLNSYLALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3324 - protein, 214 aa, Artificial Sequence
  Description of Artificial Sequence: Synthetic polypeptide
DIQMTQSPSTLSASVGDRVTITCRASESIDGWLAWYQQKPGKPPKLLIYKASNLHSGVPSRFSGSGSGTEFTLTISSLQPDDFATYHCQQYFRSPHTFGQGTNLETRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3325 - protein, 274 aa, Artificial Sequence
  Description of Artificial Sequence: Synthetic polypeptide
GGSGGGGSASQVQLQESGPGLVRPSQTLSLTCTVSGVSISSPNWWSWIRQSPGKGLEWIGEVYHSGDTDYNPSLKSRLSISLDKSKNQFSLRLSSMTAADTAVYYCARAKGIAAAGADYWGQGTLVTVSSGILGSGGGGSGGGGSGGGGSQPVLTQSPSVSGTPGQRVTISCSGTSSNIGDNYVYWYQQLPGRAPKLLIFKSNQRPPGVPDRFSASSSGTSASLAISGLQSEDEADYHCAAWDDSLSGWVFGGGTKLTVLSGILEQKLISEEDL

SEQ ID NO: 3326 - protein, 287 aa, Artificial Sequence
  Description of Artificial Sequence: Synthetic polypeptide
VQASGGGGSGGGGSGGGGSASQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARSSYSRGWSVDVWGQGTLVTVSSGILGSGGGGSGGGGSGGGGSQPVLTQSPSASATPGQRVTISCSGSSSNIGRHYVYWYQQLPGTAPKLLIYRNNQRPSGVPDRFSGSKSGTSASLAITGLQAEDEADYYCQSYDSSLRVVFGGGTKLTVLSGILEQKLISEEDL

SEQ ID NO: 3327 - protein, 736 aa, Artificial Sequence
  Description of Artificial Sequence: Synthetic polypeptide
KVTLKESGPTLVKPRQTLTLTCTFSGFSLSTSGMRVSWVRQPPGKALEWIARIDWDDDKFYSTSLKTRLTISKDTFKNQVVLTMTNMDPVDTAMYYCVRTPYNWNDGPRGALDIWGQGTMVTVSSGGDRSDGGASGGGGSQSMLTQSPSVSAAPGQNVTISCSGDYPNIRNNYVSWYQQLPGAAPKLLIYDNNKRPSGIPDRFSGSKSGTSATLDITGLQTGDEADYYCGAWDSRLSAVVFGGGTKLTVLGGQAGQGPDKTHTCPPCPAPEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAAAGGGGSQLQLQESGGGLVQPGGSLRLSCAASGFTFSSHSMNWIRQAPGKRLEWVSSISSSSSYIYYADSVRGRFTISRDNAKNSLYLQMDSLRAEDTAVYYCARYMAGIWTFDIWGQGTMVTVSSGGGGSGGGASGGGGSSYELTQPPSVSVAPGKTASISCGGDNIGRKSVHWFQQKPGQAPVLVLYDDSDRPSGIPARFSGSNSGNTATLTISGVEAGDEADYYCQVWARSSDLPNWVFGGGTKLTVLG

SEQ ID NO: 3328 - protein, 230 aa, Artificial Sequence
  Description of Artificial Sequence: Synthetic polypeptide
EVQLVESGGGVVQPGRSLRLSCAASGFSFSSYGMHWVRQAPGKGLEWVAVIWYDGSKTYYGDSVKGRFTISKDNSKKMVNLQMDSLGVEDTAFYYCARGIAGGWAFWGIDLWGQGTLVTVSSDVVMTQSPGTLSLSPGERATLSCRASQNVYSYLGWYQHKPGRSPRLLIFGVTSRATGVPDRFSGSGSGTDFTLTISRLEPEDFAVYYCQQYAGSAYTFGQGTKVEIKR

SEQ ID NO: 3329 - protein, 135 aa, Artificial Sequence
  Description of Artificial Sequence: Synthetic polypeptide
WVPGSWAQVQLVQSGAELRKPGSSVKVSCRASGGTFSSYTFNWVRQAPGQGLEWMGGFIPVFNTTNYAQTFQGRVTIAADKSTSTAYMELRSLRSEDTAIYYCARDKELLFSRAFDIWGQGTMVTVSSAGTKGPS

SEQ ID NO: 3330 - protein, 272 aa, Artificial Sequence
  Description of Artificial Sequence: Synthetic polypeptide
EVQLVESGGGLVQPGGSLRLSCSASGFTFSTYSMHWVRQAPGKGLEYVSAITGEGDSAFYADSVKGRFTISRDNSKNTLYFEMNSLRPEDTAVYYCVGGYSNFYYYYTMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPLEDDDDKAGWSHPQFEKGGGSGGGSGGGSWSHPQFEK

SEQ ID NO: 3331 - protein, 217 aa, Artificial Sequence
  Description of Artificial Sequence: Synthetic polypeptide
DVQLVEPGAELVQPGASVKMSCKASGYTFSSYWINWEKQRPGKGLEWIGNIYPGSGTVNYDDKFKSKATLTIDTSSNTAYMQLSSLTSEDSAVYYCTRGGSHAMDYWGQGTSVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPR

SEQ ID NO: 3332 - protein, 232 aa, Artificial Sequence
  Description of Artificial Sequence: Synthetic polypeptide
GSWAQVQLVESGGGVVQPGRSLRLSCAASGFTFSAYGMHWVRQAPGKGLEWVAIIWYDGSNKYYADSVKGRFTISRDNSKNTLHLQMNSLRAEDTAIYYCARDKNPGTKPYYHYGMDVWGQGTTVTVSSAGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3333 - protein, 109 aa, Artificial Sequence
  Description of Artificial Sequence: Synthetic polypeptide
LQQSGAELVRPGASVKLSCKALGYRFTDYEMYWVKQTPAHGLEWIGGIHPRSGNTAYNQKFKDKATLTADKSSSTAYMELSSLTSEDSVVYYCTTSLYWGQGTTVTVSS

SEQ ID NO: 3334 - protein, 109 aa, Artificial Sequence; identical to SEQ ID NO: 3333
  Description of Artificial Sequence: Synthetic polypeptide

SEQ ID NO: 3335 - protein, 111 aa, Artificial Sequence
  Description of Artificial Sequence: Synthetic polypeptide
SYELTQPPSVSVAPGKTASISCGGDNIGRKSVHWFQQKPGQAPVLVLYDDSDRPSGIPARFSGSNSGNTATLTISRVEAGDEADYYCQVWARSSDHPNWVFGGGTKLTVLG

SEQ ID NO: 3336 - protein, 111 aa, Artificial Sequence
  Description of Artificial Sequence: Synthetic polypeptide
SYELTQPPSVSVAPGKTASISCGGDNIGRKSVHWFQQKPGQAPVLVLYDDSDRPSGIPARFSGSNSGNTATLTISGVEAGDEADYYCQVWARSSDLPNWVFGGGTKLTVLG

SEQ ID NO: 3337 - protein, 125 aa, Artificial Sequence
  Description of Artificial Sequence: Synthetic polypeptide
KVTLKESGPTLVKPRQTLTLTCTFSGFSLSTSGMRVSWVRQPPGKALEWIARIDWDDDKFYSTSLKTRLTISKDTFKNQVVLTMTNMDPVDTAMYYCVRTPYNWNDGPRGALDIWGQGTMVTVSS

SEQ ID NO: 3338 - protein, 126 aa, Artificial Sequence
  Description of Artificial Sequence: Synthetic polypeptide
EVQLVESGGGLVKPGGSLRLSCTASGFSFSSSSMNWVRQAPGKGLQWVSYISTSGNYIYYADSVKGRFTISRDNAKNSVYLQMNSLRVEDTAVYYCARDPCSSTTCYFGYYAMDVWGQGTTVAVSS

SEQ ID NO: 3339 - protein, 121 aa, Artificial Sequence
  Description of Artificial Sequence: Synthetic polypeptide
QVQLQESGPTLVKPSQTLSLTCSVSGGSISSASYYWSWIRQPAGKGLEWIGQIYTSGSTKYNPSLKSRLTLSMDTSKNQFTLKLSSVTAADTALYYCAREWAARGGIVDYWGQGTLVTVSS

SEQ ID NO: 3340 - protein, 127 aa, Artificial Sequence
  Description of Artificial Sequence: Synthetic polypeptide
QVQLQESGPGLVKSSQTLSLTCTVSGGSISSSGYSWNWIRQPAGKGLEWIGRISASGTTNYNPSVKSRGTVSVDTSKNQFSLRLTSVTAADTAVYYCARDTECSDTSCFPSIWFDTWGQGALVTVSS

SEQ ID NO: 3341 - protein, 118 aa, Artificial Sequence
  Description of Artificial Sequence: Synthetic polypeptide
QLQMHESGPGLVKPSETLSLTCIVSSGSISTSDYYWGWIRQPPGKGLEWIGSVYYSESTYYSPSLKSRITISVDTSRNQFSLNVSSVTAADTAIYFCARQRGNWFDSWGQGTLVTVSS

SEQ ID NO: 3342 - protein, 118 aa, Artificial Sequence
  Description of Artificial Sequence: Synthetic polypeptide
QLQMHESGPGLVKPSETLSLTCTVSSGSISTSDYYWGWIRQPPGKGLEWIGSVYYSESTYYSPSLKSRITISVDTSRNQFSLNVSSVTAADTAIYFCARQRGNWFDSWGQGTLVTVSS

SEQ ID NO: 3343 - protein, 124 aa, Artificial Sequence
  Description of Artificial Sequence: Synthetic polypeptide
QAHLVESGGGVVQPGRSLRLSCAASAFNFSTNAMHWVRQAPGKGLEWVAVISYDGSHKYYADSVKGRFTISRDNSKNTLYLQMNSLRAADTAVYYCATVGVLTWPVNAEYFHHWGQGSLVSVSS

SEQ ID NO: 3344 - protein, 124 aa, Artificial Sequence
  Description of Artificial Sequence: Synthetic polypeptide
EVQLVESGGGLVQPGRSLRLSCAASGFTFDDYAMFWVRQAPGKGLEWISGISWNSATIGYADSVKGRFTISRDNAKKSLDLQMNSLRPDDTALYYCAKGGPRGLQLLSSWVDYWGQGTLVTVSS

SEQ ID NO: 3345 - protein, 128 aa, Artificial Sequence
  Description of Artificial Sequence: Synthetic polypeptide
EVQLVESGGGWVQPGGSLRLSCAASGFTFSRYDMHWVRQVTGKGLEWVSAITTAGDTYYPDSVKGRFTISRENAKSSLYLQMNNLRAGDTALYYCARGPPTDCSSGRCLGVGVGLDPWGQGTLVTVSS

SEQ ID NO: 3346 - protein, 127 aa, Artificial Sequence
  Description of Artificial Sequence: Synthetic polypeptide
QVQLVQSGAEVKKPGASVRLSCKASGYTFTNYYLHWVRQAPGQGLEWMGIIDPTGGTTPYAQKFHGRFTMTSDTSTSTVFMELSSLRLDDTAVYYCARGGGYSRNWYSYQNYGLDVWGRGTTVTVSS

SEQ ID NO: 3347 - protein, 122 aa, Artificial Sequence
  Description of Artificial Sequence: Synthetic polypeptide
EVQLVESGGGLVQPGGSLRLSCAASGFTFNRSWMNWVRQAPGKGLEWVANIIPDGSEKYYMDSVKGRFTVSRDNTKNSVYLQMNSLRAEDTAVYYCARVAEFDYVWGSFDFWGQGTLVTVSS

SEQ ID NO: 3348 - protein, 122 aa, Artificial Sequence
  Description of Artificial Sequence: Synthetic polypeptide
EVQLVESGGGLVQPGGSLRLSCAASGFTFSRSWMNWVRQAPGKGLEWVANIIPDGSEKYYMDSVKGRFTVSRDNTKNSVYLQMNSLRAEDTAVYYCARVAEFDYVWGSFDFWGQGTLVTVSS

SEQ ID NO: 3349 - protein, 125 aa, Artificial Sequence
  Description of Artificial Sequence: Synthetic polypeptide
EEQLVESGGGLVKPGGSLRLSCGASGFTFSYAWMSWVRQAPGKGLEWVARIKSKMNGETTDYAAPVKGRFTISRDDSKNTLYLQMSSLKTEDTAVYYCITDPGNAGSASYGMDVWGQGTTVTVSS

SEQ ID NO: 3350 - protein, 122 aa, Artificial Sequence
  Description of Artificial Sequence: Synthetic polypeptide
EVQLVESGGGLVRPGGSLRLSCAASGFTFNTFDMNWVRQAPGRGLEWVSSISGSSSYIYYADSVKGRFTISRDNAKNSLYLQMNSLRAEDTAVYYCSRVLWDSSSTGTFDSWGQGTRVTVSS

SEQ ID NO: 3351 - protein, 119 aa, Artificial Sequence
  Description of Artificial Sequence: Synthetic polypeptide
QVQLQESGPGLLKASETLSLTCTVSGGSVSSGSYYWTWIRQPPGKGLEWIGYIYYSGPTNYNPSLKSRVTMSVDTSKNQFSLKVRSVTAADTAVYYCARAFAKNWFDPWGQGTLVTVSS

SEQ ID NO: 3352 - protein, 116 aa, Artificial Sequence
  Description of Artificial Sequence: Synthetic polypeptide
QVQLVQSGAEVKKPGASVKVSCKASGFNIKDTYMSWVRQAPEQGLEWMGRIDPENGDTKYDPKLQGRVTMTADTSTNTAYMELRSLRSDDTAVYYCVRGWEGFAYWGQGTLVTVSS

SEQ ID NO: 3353 - protein, 116 aa, Artificial Sequence
  Description of Artificial Sequence: Synthetic polypeptide
QVQLVQSGAEVKKPGASVKVSCKASGFNIKDTYMSWVRQAPEQGLEWMGRIDPENGDTKYDPKLQGRVTMTADTSTNTAYMELRSLRSDDTAVYYCSRGWEGFAYWGQGTLVTVSS

SEQ ID NO: 3354 - protein, 116 aa, Artificial Sequence
  Description of Artificial Sequence: Synthetic polypeptide
QVQLVQSGAEVKKPGASVKVSCKASYWNIKDTYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3355 - protein, 116 aa, Artificial Sequence
  Description of Artificial Sequence: Synthetic polypeptide
QVQLVQSGAEVKKPGASVKVSCKASGFNIKDVYMSWVRQAPEQGLEWMGRIDPENGDTKYDPKLQGRVTMTADTSTNTAYMELRSLRSDDTAVYYCVRGWEGFAYWGQGTLVTVSS

SEQ ID NO: 3356 - protein, 117 aa, Artificial Sequence
  Description of Artificial Sequence: Synthetic polypeptide
QVKLLEQSGAELVKPGASVRLSCTASGFNIKDTYMSWVKQRPEQGLEWIGRIDPENGDTKYDPKFQGKATITADTSSNTAYLHLSSLTSGDTAVYYCSRGWEGFAYWGQGTLVTVSA

SEQ ID NO: 3357 - protein, 116 aa, Artificial Sequence
  Description of Artificial Sequence: Synthetic polypeptide
QVKLLEQSGAELVKPGASVRLSCTAGFNIKDTYMSWVKQRPEQGLEWIGRIDPENGDTKYDPKFQGKATITADTSSNTAYLHLSSLTSGDTAVYYCSRGWEGFAYWGQGTLVTVSA

SEQ ID NO: 3358 - protein, 115 aa, Artificial Sequence
  Description of Artificial Sequence: Synthetic polypeptide
QVQLVQSGAEVKKPGASVKVSCKAGFNIKDVYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3359 - protein, 123 aa, Artificial Sequence
  Description of Artificial Sequence: Synthetic polypeptide
TRVLSQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSS

SEQ ID NO: 3360 - protein, 115 aa, Artificial Sequence
  Description of Artificial Sequence: Synthetic polypeptide
QVQLVQSGAEVKKPGASVKVSCKAGFNIKDVYMSWVRQAPGQGLEWMGRIDPENGDTKYDPKLQGRVTMTADTSTNTAYMELRSLRSDDTAVYYCARGWEGFAYWGQGTLVTVSS

SEQ ID NO: 3361 - protein, 116 aa, Artificial Sequence
  Description of Artificial Sequence: Synthetic polypeptide
QVQLVQSGAEVKKPGASVKVSCKASGFNIKDTYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3362 - protein, 116 aa, Artificial Sequence
  Description of Artificial Sequence: Synthetic polypeptide
QVQLVQSGAEVKKPGASVKVSCKASGFNIKDVYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3363 - protein, 116 aa, Artificial Sequence
  Description of Artificial Sequence: Synthetic polypeptide
QVQLVQSGAEVKKPGASVKVSCKASGFNIKDVYMSWVRQAPGQGLEWMGRIDPENGDTKYDPKLQGRVTMTADTSTNTAYMELRSLRSDDTAVYYCARGWEGFAYWGQGTLVTVSS

SEQ ID NO: 3364 - protein, 115 aa, Artificial Sequence
  Description of Artificial Sequence: Synthetic polypeptide
QVQLVQSGAEVKKPGASVKVSCKAGFNIKDTYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3365 - protein, 128 aa, Artificial Sequence
  Description of Artificial Sequence: Synthetic polypeptide
EVQLVESGAEVKKPGSSVKVSCKASGGTFNNYAISWVRQAPGQGLEWMGGIIPIFGGANYAQKFQGRVTITADRSTSTVYMELSGLRSEDTAVYYCARRPQSIFDWNFDLWGRGTLVTVSSAGTKGPS

SEQ ID NO: 3366 - protein, 148 aa, Artificial Sequence
  Description of Artificial Sequence: Synthetic polypeptide
AATMEWSWVFLFFLSVTTGVHSQVQLVQSGAEVKKPGASVKVSCKASGYTFTNYFLHWVRQAPGQGLEWMGIIKPSSGGTTNAQKFQGRVTMTRDTSTNTFYMELSSLISEDTAVYYCARESTPISVADDYYFGMDVWGQGTTVTVSS

SEQ ID NO: 3367 - protein, 118 aa, Artificial Sequence
  Description of Artificial Sequence: Synthetic polypeptide
QVQLQQSGAELVKPGASVKLSCTASGFNIKDTYIHWVKQRPGQGLEWIGRIDPENGNAKYDPNFQAKATITADTSSNTAYLHLSSLTSEDTAVYYSVRTGSFWYFDVWGAGTTVTVSS

SEQ ID NO: 3368 - protein, 118 aa, Artificial Sequence
  Description of Artificial Sequence: Synthetic polypeptide
EVQLQQSGAELVRPGVSVKISCKGSGYTFTDYAITWVKESHAKSLEWIGLISTYYGDSFYNQKFKGKATMTVDKSSRTAYMELARLTSEDSAIYYCTIRDGKGAMDYWGQGTSVTVSS

SEQ ID NO: 3369 - protein, 129 aa, Artificial Sequence
  Description of Artificial Sequence: Synthetic polypeptide
EVKLVESGGGLVKPGGSLKLSCATSGFTFSTYGMSWVRQTPEKRLEWVATISGDGSYTYYPDTVKGRFTISRDNAKNNLYLQMSSLRSEDTALYYCASYNYGGFAYWGQGTLVSVSAAKTTPPSDYPLA

SEQ ID NO: 3370 - protein, 128 aa, Artificial Sequence
  Description of Artificial Sequence: Synthetic polypeptide
EVQLQQSGSELVRPGVSVKISCKGSGYTFTDYAHWVRQSHDKSLEWIGLISTYYGDVSYNQKFKGKATTVDKSSSTAYLELARLTSEDSAIYYCARLGGDFFADYWGQGTSVTVSSAKTTPPSDYPLA

SEQ ID NO: 3371 - protein, 124 aa, Artificial Sequence
  Description of Artificial Sequence: Synthetic polypeptide
QVQLKESGPGLVQPSQSLSITCTVSGFSLTDYGVHWIRQSPGKGLEWLGVIWRGGITDYNAAFMSRLSITKDNSKSQVFFKMDSLQPDDSAIYYCAKNFGTHYYGSNYGNFDYWGQGTTLTVSS

SEQ ID NO: 3372 - protein, 134 aa, Artificial Sequence
  Description of Artificial Sequence: Synthetic polypeptide
EVKLVESGGDLVKPGGSLKLSCAASGFTFSNFAMSWVRQTPEKRLEWVATIGGGGDSYFPDSVKGRFTISRDNARNILYLQMSSLRSDDTAMYFCTREGGDDDQYYYSMDYWGQGTSVTVSSAKTTPPSDYPLA

SEQ ID NO: 3373 - protein, 122 aa, Artificial Sequence
  Description of Artificial Sequence: Synthetic polypeptide
EVQLLESGGGLVQPGGSRRLSCAASGFTISDNVMHWVRQAPGKGLEWVALIYSADTTHYADSVKGRFTISRDNSKNTLYLQMDSLRPEDTAVYYCAREYCTGDTCFAHFDYWGQGTLVSVSS

SEQ ID NO: 3374 - protein, 122 aa, Artificial Sequence
  Description of Artificial Sequence: Synthetic polypeptide
EVQLLESGGGLVQPGGSRRLSCAASGFTISDNVMHWVRQAPGKGLEWVALIYSADSTHYADSVKGRFTISRDNSKNTLYLQMDGLRPEDTAVYYCAREYCTGGTCFAHFDYWGQGTLVTVSS

SEQ ID NO: 3375 - protein, 122 aa, Artificial Sequence; identical to SEQ ID NO: 3373
  Description of Artificial Sequence: Synthetic polypeptide

SEQ ID NO: 3376 - protein, 123 aa, Artificial Sequence
  Description of Artificial Sequence: Synthetic polypeptide
EVQLLEQSGGGLVQPGGSRRLSCAVSGFTISDNVMHWVRQAPGKGLEWVALIYSADTTHYADSVKGRFTISRDNSKNTLYLQMDSLRPEDTAVYYCAREYCTGGTCFAHFDYWGQGTLVTVSS

SEQ ID NO: 3377 - protein, 125 aa, Artificial Sequence
  Description of Artificial Sequence: Synthetic polypeptide
EVQLLESGPGLVKPSQTLSLTCAVSGGSITSDHYFWSWMRQAPGRGLEWIGYISYRGTTYYNPSLKSRVTMSVTAAKNTLYLQMDGLRPEDTAVYYCARASVTAGMPAAGTLDHWGQGTLVTVSS

SEQ ID NO: 3378 - protein, 121 aa, Artificial Sequence
  Description of Artificial Sequence: Synthetic polypeptide
EVQLLEESGAEVKKPGSSVKVSCKVSGGTFSRNPISWVRQAPGQGLEWMGVIVPIVGTTKHAQKFQGRVTIIADESTSTAYMELSSLRSEDTAVYYCATYYADGSSYSEYWGQGTLVTVSS

SEQ ID NO: 3379 - protein, 123 aa, Artificial Sequence
  Description of Artificial Sequence: Synthetic polypeptide
EVQLLESGPGLVKPSETLSLTCTVSGGSISDFYWSWLRQSPGKGLEWIGYAHSRVSAYYNPSLKSRVTISVDTSKNQLSLRLSAVTAADTALYYCARQGTGTTGVSEDPFDLWGQGTKVIVSL

SEQ ID NO: 3380 - protein, 129 aa, Artificial Sequence
  Description of Artificial Sequence: Synthetic polypeptide
EVQLLESGGGLVQPGGSLRLSCAASGVTFSSYWMHWVRQAPGKGLEWVSRINSDGSSTNYADSVEGRFTISRDNAKNTLYLQMNSLRAEDTAVYYCSRGGLWDWSPRRIEETKTPFDYWGQGTLVTVSS

SEQ ID NO: 3381 - protein, 122 aa, Artificial Sequence
  Description of Artificial Sequence: Synthetic polypeptide
EVQLLESGAEVKKPGGSVKVSCKVSGGTLSSYGISWVRQAPGQGPEWMGVIIPIRGTANYAQKFQGRVTYTADESTSTVYMELSSLRSEDTAVYYCATGRRGRYPTGSFDYWGQGALVTVSS

SEQ ID NO: 3382 - protein, 123 aa, Artificial Sequence
  Description of Artificial Sequence: Synthetic polypeptide
EVQLLEQSGAEVKKPGGSVKVSCKVSGGTFSRNPISWVRQAPGQGLEWMSVIVPIVGTTKHAQKFQGRVTITADESTSTAYMELSSLRSEDTAVYYCATYRRYADVSSYSEYWGQGTLVTVSS

SEQ ID NO: 3383 - protein, 123 aa, Artificial Sequence
  Description of Artificial Sequence: Synthetic polypeptide
EVQLLESGGGLVQPGGSLTLSCAASGFTFSSYWMHWVRQAPGKGPEWVALIKKDGSEKYYAESVKGRFTISRDNAKNSLYLQMNSLRAEDTAVYYCTRRITTLTVISDAFDIWGQGTMVTVSS

SEQ ID NO: 3384 - protein, 123 aa, Artificial Sequence
  Description of Artificial Sequence: Synthetic polypeptide
EVQLLESGPGLVKPSETLSLTCTVSGGSISDFYWSWLRQSPGKGLEWIGVAHSRVSAYYNPSLKSRVTISVDTSKNQLSLRLSAVTAADAALYYCARQGTGTTGVSEDPFDLWGQGTKVIVSL

SEQ ID NO: 3385 - protein, 122 aa, Artificial Sequence
  Description of Artificial Sequence: Synthetic polypeptide
EVQLVESGGGVVQPGRSLRLSCAASGFSFSSYGMHWVRQAPGKGLEWVAVIWYDGSKTYYGDSVKGRFTISKDNSKKMVNLQMDSLGVEDTAFYYCARGIAGGWAFWGIDLWGQGTLVTVSS

SEQ ID NO: 3386 - protein, 117 aa, Artificial Sequence
  Description of Artificial Sequence: Synthetic polypeptide
EVKLLEQSGAELVKPGASVRLSCTASGFNIKDTYMSWVKQRPEQGLEWIGRIDPANGDTKYDPKFQGKATITADTSSNTAYLHLSSLTSGDTAVYYCSRGWEGFAYWGQGTLVTVSA

SEQ ID NO: 3387 - protein, 117 aa, Artificial Sequence
  Description of Artificial Sequence: Synthetic polypeptide
EVKLLEQSGAELVKPGASVRLSCTASGFNIKDTYMSWVKQRPEQGLEWIGRIDPENGDTKYDPKFQGKATITADTSSNTAYLHLSSLTSGDTAVYYCSRGWEGFAYWGQGTLVTVSA

SEQ ID NO: 3388 - protein, 117 aa, Artificial Sequence; identical to SEQ ID NO: 3387
  Description of Artificial Sequence: Synthetic polypeptide

SEQ ID NO: 3389 - protein, 118 aa, Artificial Sequence
  Description of Artificial Sequence: Synthetic polypeptide
WVPGVHSDIQMTQSPSSLSASVGDRVTITCRASQSISRYLNWYQREPGKAPKLLIYGASSLQRGVPSRFSGSGSGTDFTLTISSLQPEDFATYYCQQSQYIPYTFGQGTKVDIKRTVA

SEQ ID NO: 3390 - protein, 217 aa, Artificial Sequence
  Description of Artificial Sequence: Synthetic polypeptide
RSEIVLTQSPATLSLSPGERATLSCRASQSISTFLAWYQHKPGQAPRLLIYDASTRATGVPARFSGSRSGTDFTLTISTLEPEDFAVYYCQQRYNWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3391 - protein, 213 aa, Artificial Sequence
  Description of Artificial Sequence: Synthetic polypeptide
DIVMTQSQKFMSTSVGDRVSITCKASQNVRTSVAWYQQKPGQSPKALIYLASNRHTGVPDRFTGSGSGTDFTLTISNVQSEDLADYFCLQHWTYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 3392 - protein, 239 aa, Artificial Sequence
  Description of Artificial Sequence: Synthetic polypeptide
LATMAWMMLLLLTLITHCAGSWAQSVLTQPPSVSEAPRQRVTISCSGSSSNIGNNAVNWYQQFPGKAPKLLIYYDDLLPSGVSDRFSGSKSGTSASLAISGLQSEDEAYYYCAAWDDSLIGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3393 - protein, 205 aa, Artificial Sequence
  Description of Artificial Sequence: Synthetic polypeptide
ILGDQASISCRSSQSLVHSNGNTYLHWYLQKPGQSPKLLIYSIFNRFSGVPDRFSGSGSGTDFTLKISRVEAEDLGVYFCSQGTHVPWTFGGGTNLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 3394 - protein, 99 aa, Artificial Sequence
  Description of Artificial Sequence: Synthetic polypeptide
LGDQASISCRSSQSLVHSNGNTYLHWYLQKPGQSPKLLIYSIFNRFSGVPDRFSGSGSGTDFTLKISRVEAEDLGVYFCSQGTHVPWTFGGGTNLEIKR

SEQ ID NO: 3395 - protein, 119 aa, Artificial Sequence
  Description of Artificial Sequence: Synthetic polypeptide
QLQLQESGGGLVQPGGSLRLSCAASGFTFSSHSMNWIRQAPGKRLEWVSSISSSSSYIYYADSVRGRFTISRDNAKNSLYLQMDSLRAEDTAVYYCARYMAGIWTFDIWGQGTMVTVSS

SEQ ID NO: 3396 - protein, 125 aa, Artificial Sequence; identical to SEQ ID NO: 3337
  Description of Artificial Sequence: Synthetic polypeptide

SEQ ID NO: 3397 - protein, 111 aa, Artificial Sequence
  Description of Artificial Sequence: Synthetic polypeptide
QSMLTQSPSVSAAPGQNVTISCSGDYPNIRNNYVSWYQQLPGAAPKLLIYDNNKRPSGIPDRFSGSKSGTSATLDITGLQTGDEADYYCGAWDSRLSAVVFGGGTKLTVLG

SEQ ID NO: 3398 - protein, 106 aa, Artificial Sequence
  Description of Artificial Sequence: Synthetic polypeptide
SYELTQPLSVSVALGQTARVTCGGNNIGSKTVHWYQQRPGQAPVLVIYRDTNRPSGIPERFSGSKSGSAATLTISRAQAGDEAEYYCQVWDGTSVVFGGGTKLTVL

SEQ ID NO: 3399 - protein, 107 aa, Artificial Sequence
  Description of Artificial Sequence: Synthetic polypeptide
DIQMTQSPSSLSASVGDRVTITCRASQSISYYLNWYQQKPGKAPKVLIYGASSLQSGVPSRFSGSGSETDFTLTISSLQPEDFATYYCQQSYDFPRTFGQGTKVEIK

SEQ ID NO: 3400 - protein, 111 aa, Artificial Sequence
  Description of Artificial Sequence: Synthetic polypeptide
SYELTQPPSVSVAPGKTATITCGGNNIGTKGVHWYQRKAGQAPVLVIYYDSVRPSGIPERFSGSNSGNTATLTISRVEAGDEADYYCQVWDNTDDSSDHPVFGGGSKLTVL

SEQ ID NO: 3401 - protein, 107 aa, Artificial Sequence
  Description of Artificial Sequence: Synthetic polypeptide
AIQLTQSPSSLSASVGDRVTITCRASQGISNYLAWYQQKPGKAPKLLIYAASTLQSGVPSRFSGSGSGTDFTLTISSLQPEDFATYYCQQLNNYEFTFGPGTKVDIK

SEQ ID NO: 3402 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLICGNNNRPSGVPDRFSGSKSGTSASLAITGLQAEDEADYYCQSYDSSLTGVVFGGGTKLTVL

SEQ ID NO: 3403 - protein, 107 aa, Artificial Sequence
  Description of Artificial Sequence: Synthetic polypeptide
DIQMTQSPSSLSASVGDRVTITCRASQDIRRYLNWYQQRPGRVPQLLIYTTSTLQSGVPSRFSGSGSVTDFTLTISSLQPEDFGTYYCQQSYSPPHTFGQGTKLEIK

SEQ ID NO: 3404 - protein, 107 aa, Artificial Sequence
  Description of Artificial Sequence: Synthetic polypeptide
DILMTQSPSFVSASVGDRVTITCRASQGISNWLAWYQQKPGKAPNLLISAASSLQSGVPSRFSGSGSGTDFTLTISSLQPEDFATYFCQQANSFPPTFGQGTKVESK

SEQ ID NO: 3405 - protein, 107 aa, Artificial Sequence
  Description of Artificial Sequence: Synthetic polypeptide
SYEVTQPPSVSVSPGQTASITCSGDKLGKKYTSWYQQKPGQSPLLVIYQDTKRPSGIPERFSGSNSGNTATLTISGTQAMDEADYYCQAWDSTTHVIFGGGTKLTVL

SEQ ID NO: 3406 - protein, 111 aa, Artificial Sequence
  Description of Artificial Sequence: Synthetic polypeptide
QAVLTQPPSVSGAPGQRVTISCTGSSSNIGAGYDVHWYQQFPGTAPKLLIYGNSDRPSGVPDRFSGSQSGTSASLAITELQAADEADFYCQSYDSSLSGFVFGTGTKVTVL

SEQ ID NO: 3407 - protein, 106 aa, Artificial Sequence
  Description of Artificial Sequence: Synthetic polypeptide
SYELTQTPSVSVSPGHAASITCSGDKLGYKYTSWYQQKPGQSPVLVIYQDTKRPSGIPERFSGSNSGNTATLTISATQAMDEADYYCQAWDSRTGVFGGGTKLTVL

SEQ ID NO: 3408 - protein, 111 aa, Artificial Sequence
  Description of Artificial Sequence: Synthetic polypeptide
DIVMTQTPLSLSVTPGQPASISCKSSQSLLHSDGKTYLYWYLQKPGQAPQLLIFEVSTRFPGVPHRFSGSGSGTDFTLKISRVEAEDVGVYYCMQSVQSLGFGGGTKVEIK

SEQ ID NO: 3409 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERLSGSNSGNTATLTISRVEAGDEADYYCQVWDSSSGPFVVFGGGTKLTVL

SEQ ID NO: 3410 - protein, 108 aa, Artificial Sequence
  Description of Artificial Sequence: Synthetic polypeptide
SYVLTQPPSVSVAPGKTARITCGGNNIGSRNVHWYQQKPGQAPVLVIYYDSDRPSGIPERFSGSNSGNTATLTISRVEAGDEADYYCQVWDGSSDVAIFGGGTKLTVL

SEQ ID NO: 3411 - protein, 111 aa, Artificial Sequence
  Description of Artificial Sequence: Synthetic polypeptide
DIVMTQSPASLAVSLGERATISCRASENVDKYGNSFMHWYQQKPGQPPKLLIYRASELQWGVPDRFSGSGSGTDFTLTISSLQAEDVAVYYCQRSNEVPWTFGQGTKLEIK

SEQ ID NO: 3412 - protein, 116 aa, Artificial Sequence
  Description of Artificial Sequence: Synthetic polypeptide
QVQLVQSGAEVKKPGASVKVSCKASGFNIQDVYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3413 - protein, 116 aa, Artificial Sequence
  Description of Artificial Sequence: Synthetic polypeptide
QVQLVQSGAEVKKPGASVKVSCKASGFNISDVYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3414 - protein, 116 aa, Artificial Sequence
  Description of Artificial Sequence: Synthetic polypeptide
QVQLVQSGAEVKKPGASVKVSCKASAFNIKDTYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3415 - protein, 116 aa, Artificial Sequence
  Description of Artificial Sequence: Synthetic polypeptide
QVQLVQSGAEVKKPGASVKVSCKASAFNIKDVYMSWVRQAPEQGLEWMGRIDPENGDTKYDPKLQGRVTMTADTSTNTAYMELRSLRSDDTAVYYCARGWEGFAYWGQGTLVTVSS

SEQ ID NO: 3416 - protein, 116 aa, Artificial Sequence
  Description of Artificial Sequence: Synthetic polypeptide
QVQLVQSGAEVKKPGASVKVSCKASGFNIKDVYMSWVRQAPEQGLEWMGRIDPENGDTKYDPKLQGRVTMTADTSTNTAYMELRSLRSDDTAVYYCSRGWEGFAYWGQGTLVTVSS

SEQ ID NO: 3417 - protein, 111 aa, Artificial Sequence
  Description of Artificial Sequence: Synthetic polypeptide
ELVMTQTPASLAVSLGQRATISCRASENVDKYGNSFMHWYQQKAGQPPKLLIYRASELQWGIPARFSGSGSRTDFTLTINPVEADDVATYFCQRSNEVPWTFGGGTKLEIK

SEQ ID NO: 3418 - protein, 105 aa, Artificial Sequence
  Description of Artificial Sequence: Synthetic polypeptide
SSELTQDPAVSVALGQTVRITCRGDSLRSYYASWYQQKPGQAPVLVIYGENNRPSGIPDRFSGSSSGDTASLTITGAQAEDEADYYCNSRDSSDHLLLFGQGTKL

SEQ ID NO: 3419 - protein, 115 aa, Artificial Sequence
  Description of Artificial Sequence: Synthetic polypeptide
QSVLTQPPSASGTPGQRVTISCSGSSSNVGSNYVYWYQQLPGTAPKLLIYRNNRRPSGVPDRFSGSKSGTSASLAISGLRSEDEADYYCATWDDSLSGLVFGGGTKLTVLGQPKA

SEQ ID NO: 3420 - protein, 238 aa, Artificial Sequence
  Description of Artificial Sequence: Synthetic polypeptide
KLTMGVPTQVLGLLLLWLTDARCQSVLTQPPSASGTPGQRVTISCSGSTSNIGSNTVNWYQQLPGTAPKLLIYSNDQRPSGVPDRFSGSKSGTSASLAISGLQSEDEADYYCAAWDDSLNGLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3421 - protein, 111 aa, Artificial Sequence
  Description of Artificial Sequence: Synthetic polypeptide
DIVLTQSPASLAVSLGQRATISCRASESVDKYGITFLNWFQQKPGQPPKLLIHSASNRGSGVPARFSGSGSGTDFSLNIHPMEEDDIAMYFCQQSKEVPWTFGGGTKLEIK

SEQ ID NO: 3422 - protein, 116 aa, Artificial Sequence
  Description of Artificial Sequence: Synthetic polypeptide
DIVMTQSHKFMSTSVGDRVSITCKASQDVGIAVAWYQQKPRQSPKLLIYWASTRHTGVPDRFTGSGSGTDLTLTINNVQSEDLADYFCQQFNSYPLTFGGGTKLEIKRADAAPTVS

SEQ ID NO: 3423 - protein, 120 aa, Artificial Sequence
  Description of Artificial Sequence: Synthetic polypeptide
DVLTQTPLSLPVSLGDQASISCRSSQSVVNSNGNTYLEWYLQKPGQSPKLLIYKVSNRFSGVPDRFSGSGSGTDFTLKISRVEAEDLGVYYCFQGSHFPRTFGGGTKLEIKRADAAPTVS

SEQ ID NO: 3424 - protein, 106 aa, Artificial Sequence
  Description of Artificial Sequence: Synthetic polypeptide
VVMTQTPKFLLVSAGDRVTITCKASQSVSNDVAWYQQKPGQSPKLLIYYVSNRYSGVPDRFTGSGYGTDFTFTINTVQAEDLAVYFCQQDYSSPYTFGGGTKLEIK

SEQ ID NO: 3425 - protein, 120 aa, Artificial Sequence
  Description of Artificial Sequence: Synthetic polypeptide
QAVVTQESALTTSPGETVTLTCRSSTGAVTTSNYANWVQEKPDRLFNGLIGGTNNRAPGVPARFSGSLIGDKAALTITGAQPEDEAIYFCALWYSNHFWVFGGGTKLTVLGQPKSTPTLT

SEQ ID NO: 3426 - protein, 109 aa, Artificial Sequence
  Description of Artificial Sequence: Synthetic polypeptide
ELQMTQSPSSLSASVGDRVTITCRASQDISIRLNWYQQKPGKAPKLLIYDASTLESGVPSRFSGSGSGTDFTLTISSLQPEDFATYYCQQFNSYPLTFGGGTKVEIKRT

SEQ ID NO: 3427 - protein, 108 aa, Artificial Sequence
  Description of Artificial Sequence: Synthetic polypeptide
ELTQGPATLSLSPGERATLSCRAGQSLDSSLLSWYQQKPGQAPRLLMYDASTRAPGVPARFSGSGSGTDFTLTISSLQPEDFAVYYCQQHYNLPRTFGQGTKLEIKRT

SEQ ID NO: 3428 - protein, 109 aa, Artificial Sequence
  Description of Artificial Sequence: Synthetic polypeptide
ELQMTQSPSTLSASVGDRVTVTCRASEDLNKWLAWYQQKPGKAPKLLIYKASSLESGVPSRFSGSGSGTEFTLTISSLQPDDFATYYCQQYQSYPYTFGPGTKLEIKRT

SEQ ID NO: 3429 - protein, 112 aa, Artificial Sequence
  Description of Artificial Sequence: Synthetic polypeptide
ELTQSPLSLPVTLGQPASISCRSSQNLVHSDGNTYLSWIQQRPGQPPRLLIYKVSNRDSGVPDRFSGSGAGTDFTLKITRVEAEDVGLYYCVQGVQFPITFGQGTKLEIKRT

SEQ ID NO: 3430 - protein, 107 aa, Artificial Sequence
  Description of Artificial Sequence: Synthetic polypeptide
ELTQSPSTLSASVGDRVTITCRASQGISSWLAWYQQKPGKAPKFLIYKASSLESGVPSRFSGSGSGTEFTLTISSLQPDDFATYYCQQYGSYPLTFGPGTKVDIKRT

SEQ ID NO: 3431 - protein, 107 aa, Artificial Sequence
  Description of Artificial Sequence: Synthetic polypeptide
ELTQSPSSLSASVGDRVTITCRASQGISNRLNWYQQKPGQGPKFLMYDASSLVSGVPSRFSGSGSGTDFTLTISSLQPEDFAVYYCQQFNSYPLTFGGGTKLEIKRT

SEQ ID NO: 3432 - protein, 108 aa, Artificial Sequence
  Description of Artificial Sequence: Synthetic polypeptide
ELQMTQSPSSVSASVGDTVTIACRASQSITNYLSWYQQKPGKAPKLLIYHASTLQSGIPSRFSGSGSGTDFTLTISSLQPDDFATYYCHYGYGTHTFGQGTKLEIKRT

SEQ ID NO: 3433 - protein, 108 aa, Artificial Sequence
  Description of Artificial Sequence: Synthetic polypeptide
ELQMTQSPSSLSASVGDRVTITCRASQSITNYLSWYQQKPGKAPKLLISYSSTLQSGVPSRFSGSGSGTDFTLTISSLQPEDFATYYCHYGYGTHTFGPGTKVDIKRT

SEQ ID NO: 3434 - protein, 106 aa, Artificial Sequence
  Description of Artificial Sequence: Synthetic polypeptide
ELTQSPSSVSASVGDRVTITCRASQTITNYVSWYQQKPGKAPNLLIYFASTLHSGVPSRFSGSGSGTDFTLTINSLQPDDFATYYCQYGYGTQTFGQGTKLEVKRT

SEQ ID NO: 3435 - protein, 106 aa, Artificial Sequence
  Description of Artificial Sequence: Synthetic polypeptide
ELTQSPSSVSASVGDTVTIACRASQSITNYLSWYQQKPGKAPKLLIYHASTLQSGIPSRFSGSGSGTDFTLTISSLQPDDFATYYCHYGYGTHTFGQGTKLEIKRT

SEQ ID NO: 3436 - protein, 109 aa, Artificial Sequence
  Description of Artificial Sequence: Synthetic polypeptide
ELQMTQSPSSLSASVGDRVTITCRASQGISSELNWYQQKPGKAPKLLIYDASSLESGVPSRFSGSGSGTDFTLTISSLQPEDFATYYCQHFNSFPWTFGQGTKLEIKRT

SEQ ID NO: 3437 - protein, 114 aa, Artificial Sequence
  Description of Artificial Sequence: Synthetic polypeptide
ELQMTQSPLSLSVAPGQPASISCKSSQSLLHSDGNTYLFWYLQKSGQSPQLLIYGLSNRASGVPDRFSGSGSGTDFTLKISQVEAEDVGVFYCMQGTQLPYTFGQGTKLEIKRT

SEQ ID NO: 3438 - protein, 108 aa, Artificial Sequence
  Description of Artificial Sequence: Synthetic polypeptide
DVVMTQSPGTLSLSPGERATLSCRASQNVYSYLGWYQHKPGRSPRLLIFGVTSRATGVPDRFSGSGSGTDFTLTISRLEPEDFAVYYCQQYAGSAYTFGQGTKVEIKR

SEQ ID NO: 3439 - protein, 112 aa, Artificial Sequence
  Description of Artificial Sequence: Synthetic polypeptide
ELVMTQTPASLAVSLGQRATISCRASENVDRYGNSFMHWYQQKAGQPPKLLIYRASNLESGIPARFSGSGSRTDFTLTINPVEADDVATYFCQRSNEVPWTFGGGTKLEIKR

SEQ ID NO: 3440 - protein, 112 aa, Artificial Sequence
  Description of Artificial Sequence: Synthetic polypeptide
ELVMTQTPASLAVSLGQRATISCRASENVDKYGNSFMHWYQQKAGQPPKLLIYRASELQWGIPARFSGSGSRTDFTLTINPVEADDVATYFCQRSNEVPWTFGGGTKLEIKR

SEQ ID NO: 3441 - protein, 112 aa, Artificial Sequence; identical to SEQ ID NO: 3440
  Description of Artificial Sequence: Synthetic polypeptide

SEQ ID NO: 3442 - protein, 229 aa, Artificial Sequence
  Description of Artificial Sequence: Synthetic polypeptide
LQQSGAELVRPGASVKLSCKALGYRFTDYEMYWVKQTPAHGLEWIGGIHPRSGNTAYNQKFKDKATLTADKSSSTAYMELSSLTSEDSVVYYCTTSLYWGQGTTVTVSSGGGGSGGGGSGGGGSLGDQASISCRSSQSLVHSNGNTYLHWYLQKPGQSPKLLIYSIFNRFSGVPDRFSGSGSGTDFTLKISRVEAEDLGVYFCSQGTHVPWTFGGGTNLEIKRADAAPT

SEQ ID NO: 3443 - protein, 153 aa, Artificial Sequence
  Description of Artificial Sequence: Synthetic polypeptide
GASQSVLTQPVSVSGSPGQSITISCTGTSSNADTYNLVSWYQQRPGKAPKLMIYEGTKRPSGVSNRFSASKSATAASLTISGLQPEDEADYYCCSYATSRTLVFGGGTKLTVVAAADDDDKAGWSHPQFEKGGGSGGGSGGGSSAWSHPQFEK

SEQ ID NO: 3444 - protein, 150 aa, Artificial Sequence
  Description of Artificial Sequence: Synthetic polypeptide
EVQLVESGGGLVRPGGSLRLSCAASGFSYSNHWMHWVRQAPGKGLVWVSRINSDGSTRNYADFVKGRFTISRDNAENTLYLEMNSLTADDTAVYYCVRDGVRFYYDSTGYYPDSFFKYGMDVWGQGTTVTVSSGTGGSGGGGSGGGGSGG

SEQ ID NO: 3445 - protein, 218 aa, Artificial Sequence
  Description of Artificial Sequence: Synthetic polypeptide
RSQSVLTQPVSVSGSPGQSITISCTGTSSNADTYNLVSWYQQRPGKAPKLMIYEGTKRPSGVSNRFSASKSATAASLTISGLQPEDEADYYCCSYATSRTLVFGGGTKLTVVGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3446 - protein, 154 aa, Artificial Sequence
  Description of Artificial Sequence: Synthetic polypeptide
SGGGASQSALTQPASVSGSPGQSITISCTGTSSDVGGFNYVSWFQQHPGKAPKLMLYDVTSRPSGVSSRFSGSKSGNTASLTISGLQAEDEADYYCSSHTSRGTWVFGGGTKLTVLAAADDDDKAGWSHPQFEKGGGSGGGSGGGSWSHPQFEK

SEQ ID NO: 3447 - protein, 144 aa, Artificial Sequence
  Description of Artificial Sequence: Synthetic polypeptide
MAEVQLVESGAEVKKPGASVKVSCKASGYTFTSYAMHWVRQAPGQRLEWMGWINAGNGNTKYSQKFQDRVTITRDTSASTAYMELSSLRSEDTAIYYCARDKVDDYGDYWFPTLWYFDYWGQGTLVTVSSGTGGSGGGGSGGGG

SEQ ID NO: 3448 - protein, 218 aa, Artificial Sequence
  Description of Artificial Sequence: Synthetic polypeptide
RSQSALTQPASVSGSPGQSITISCTGISSDVETYNLVSWYEQHPGKAPKLIIYEASKRPSGVSNRFSGSKSGNTASLAISGLQAEDEADYYCCSYAGGKSLVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3449 - protein, 283 aa, Artificial Sequence
  Description of Artificial Sequence: Synthetic polypeptide
EVQLVESGGGLVQPGGSLKLSCAASGFTFSSHWMHWVRQAPGKGLVWVSRTNSDGSSTSYADSVKGRFMISRDNSKNTVYLHMNGLRAEDTAVYFCARDGVRYYYDSTGYYPDNFFQYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPLEDDDDKAGWSHPQFEKGGGSGGGSGGGSWSHPQFEK

SEQ ID NO: 3450 - protein, 226 aa, Artificial Sequence
  Description of Artificial Sequence: Synthetic polypeptide
ELLESGGGLVQPGGSLRLSCAASGFTFSSYAMSWVRQAPGKGLEWVSSINRSGDITTYADSVKGRFTISRDNSKNTLYLQMNSLRAEDTAVYYCAKKTRRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTSGQAGQ

SEQ ID NO: 3451 - protein, 218 aa, Artificial Sequence
  Description of Artificial Sequence: Synthetic polypeptide
ESALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADGSPVKAGVETTTPSKQSNNKYAASSYLSLTPEQWKSHRSYSCQVTHEGSTVEKTVAPTECS

SEQ ID NO: 3452 - protein, 474 aa, Artificial Sequence [sequence omitted]

SEQ ID NO: 3453 - protein, 518 aa, Artificial Sequence [sequence omitted]

SEQ ID NO: 3454 - protein, 242 aa, Artificial Sequence [sequence omitted]

SEQ ID NO: 3455 - protein, 449 aa, Artificial Sequence
  Description of Artificial Sequence: Synthetic polypeptide
QVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3456 - protein, 457 aa, Artificial Sequence
  Description of Artificial Sequence: Synthetic polypeptide
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3457 - protein, 456 aa, Artificial Sequence
  Description of Artificial Sequence: Synthetic polypeptide
EVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3458 - protein, 452 aa, Artificial Sequence
  Description of Artificial Sequence: Synthetic polypeptide
QITLKETGPTLVKPTQTLTLTCTFSGFSLSTSGVGVGWIRQPPGKALEWVTLIYWDDDKRYSPSLENRVTIRKDTSKNQVALTMTNMDPLDTGTYYCAHRQHISSFPWFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3459 - protein, 448 aa, Artificial Sequence
  Description of Artificial Sequence: Synthetic polypeptide
EVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3460 - protein, 518 aa, Artificial Sequence [sequence omitted]

SEQ ID NO: 3461 - protein, 114 aa, Artificial Sequence
  Description of Artificial Sequence: Synthetic polypeptide
ELLESGGGLVQPGGSLRLSCAASGFTFSSYAMSWVRQAPGKGLEWVSSINRSGDITTYADSVKGRFTISRDNSKNTLYLQMNSLRAEDTAVYYCAKKTRRFDYWGQGTLVTVSS

SEQ ID NO: 3462 - protein, 117 aa, Artificial Sequence
  Description of Artificial Sequence: Synthetic polypeptide
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCAKGLYGELFDYWGQGTLVTVS

SEQ ID NO: 3463 - protein, 118 aa, Artificial Sequence
  Description of Artificial Sequence: Synthetic polypeptide
EVQLVESGGGLVQPGGSLRLSCAASGFTFSNYWMNWVRQAPGKGLEWVSAISGSGGSTYYADSVKGRFTISRDNSKNTLYLQMNSLRAEDTAVYYCAKDYLYPTTDFDYWGQGTLVTV

SEQ ID NO: 3464 - protein, 120 aa, Artificial Sequence
  Description of Artificial Sequence: Synthetic polypeptide
QVTLKESGPTLVKPTQTLTLTCTFSGFSLSTSGVGVGWIRQPPGKALEWLARIDWDDDKYYSTSLKTRLTISKDTSKNQVVLTMTNMDPVDTATYYCARMGFTGTYFDYWGQGTLVTVSS

SEQ ID NO: 3465 - protein, 123 aa, Artificial Sequence
  Description of Artificial Sequence: Synthetic polypeptide
QVQLVQSGGDLVQPGRSLRLSCAASGFTFSSYGMHWVRQAPGKGLEWVADISYDGSNKYYADSVKGRFTISRDNSKNTLYLQMNSLRAEDTAVYYCAKDGLDLTGTIQPFGYWGQGTLVTVSS

SEQ ID NO: 3466 - protein, 119 aa, Artificial Sequence
  Description of Artificial Sequence: Synthetic polypeptide
EVQLVESGPGLVRPSGTLSLTCAVSGGSISSSNWWSWVRQPPGKGLEWIGEIYHSGSTNYNPSLKSRVTISVDKSKNQFSLKLSSVTAADTAVYYCARVSVTTGAFNIWGQGTMVTVSS

SEQ ID NO: 3467 - protein, 119 aa, Artificial Sequence
  Description of Artificial Sequence: Synthetic polypeptide
EVQLVESGGGVVQPGRSLRLSCAASGFTFSSYGMHWVRQAPGKGLEWVAVISYDGSSKYYADSVKGRFTISRDNSKNTLYLQMNSLRAEDTAVYYCAKGSVLGDAFDIWGQGTMVTVSS

SEQ ID NO: 3468 - protein, 121 aa, Artificial Sequence
  Description of Artificial Sequence: Synthetic polypeptide
EVQLVESGAEVKKPGESLKISCKGSGYNFPYSWIAWVRQMPGKGLEWMGIIFPGDSDTRYSPPFQGQVTISADNSKSTAYLQWSSLKASDTAMYYCARTSNWNYLDRFDPWGQGTLVTVSS

SEQ ID NO: 3469 - protein, 119 aa, Artificial Sequence
  Description of Artificial Sequence: Synthetic polypeptide
EVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGSVLGDAFDIWGQGTMVTVSS

SEQ ID NO: 3470 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGSSKYYADSVKGRFTISRDNSKNTLYLQMNSLRAEDTAVYYCAKGSVLGDAFDIWGQGTMVTVSS

SEQ ID NO: 3471 - protein, 118 aa, Artificial Sequence
  Description of Artificial Sequence: Synthetic polypeptide
QVQLVQSGGGVVQPGRSLRLSCAASGFTFGSYGMHWVRQAPGKGLEWVATIFYDGSYKDYADSVKGRFTISRDNSKNTLYLQMNSLRAEDTAVYYCAKGSKVGDFDYWGQGTLVTVSS

SEQ ID NO: 3472 - protein, 128 aa, Artificial Sequence
  Description of Artificial Sequence: Synthetic polypeptide
QVQLVESGPGLVKASETLSLTCTVSDGSISSFYWSWIRQPPGKGLEWVGEIQDTGRTNYNPSLKSRVTISLDTSKNQFSLTLSSVTAADTAVYYCAREKEKYSDRSGYSYYYYYMDVWGKGTTVTVSS

SEQ ID NO: 3473 - protein, 123 aa, Artificial Sequence
  Description of Artificial Sequence: Synthetic polypeptide
QVQLVQSGGGVAQPGRSLRLSCAASGFTFSSYGMHWVRQAPGKGLEWVADISYDGSNKYYADSVKGRFTISRDNSKNTLYLQMNSLRAEDTAVYYCAKDGLDLTGTIQPFGYWGQGTLVTVSS

SEQ ID NO: 3474 - protein, 121 aa, Artificial Sequence
  Description of Artificial Sequence: Synthetic polypeptide
EVQLVQSGGHLVQPGGSLRLSCAASGFTFSSYAMSWVRQAPGKGLEWVSLIIGSGRSTYYADSVKGRFTISRDNSKNTLYLQMNSLRAEDTAVYYCAKTASNLGRGGMDVWGQGTTVTVSS

SEQ ID NO: 3475 - protein, 119 aa, Artificial Sequence
  Description of Artificial Sequence: Synthetic polypeptide
EVQLVQSGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSS

SEQ ID NO: 3476 - protein, 119 aa, Artificial Sequence
  Description of Artificial Sequence: Synthetic polypeptide
QVQLQESGGGVVQPGRSLRLSCAASGFTFSSYGMHWVRQAPGKGLEWVAVILYDGSDKYYADSVKGRFTISRDNSKNTLYLQMNSLRAEDTAVYYCAKVAVAGESFDSWGRGTLVTVSS

SEQ ID NO: 3477 - protein, 121 aa, Artificial Sequence
  Description of Artificial Sequence: Synthetic polypeptide
QVQLQESGGGVVQPGRSLRLSCAASGFTFSSYGMHWVRQAPGKGLEWVATISYDGNVKDYADSVKGRFTISRDNSKNTLYLQMNSLRTEDTAVYYCAKIVVVTALDAFDIWGQGTMVTVSS

SEQ ID NO: 3478 - protein, 120 aa, Artificial Sequence
  Description of Artificial Sequence: Synthetic polypeptide
EVQLVQSGGGLVQPGGSLRLSCAASGFTFSSYGMHWVRQAPGKGLEWVAVILYDGSDKFYADSVKGRFTISRDNSKDTLYLQMNSLRAEDTAVYYCAKFMIVADDAFDIWGQGTMVTVSS

SEQ ID NO: 3479 - protein, 118 aa, Artificial Sequence
  Description of Artificial Sequence: Synthetic polypeptide
EVQLVQSGGGLVQPGRSLRLSCAASGFTFSTYGMHWVRQAPGKGLEWVATISYDGSIKDYADSEKGRFTISRDNSKNTLYLQMNSLRAEDTAVYYCAKGGKTGEFDYWGQGTLVTVSS

SEQ ID NO: 3480 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSDKYYADSVKGRFTISRDNSKNTLYLQMNSLRAEDTAVYYCAKIATAGTGFDYWGQGTLVTVSS

(The sequence listing continues in the following parts.)

The invention claimed is:

1. An adeno associated virus (AAV) particle comprising a capsid and a viral genome, said viral genome comprising at least one inverted terminal repeat (ITR) region and a payload region, said payload region comprising a first nucleic acid segment encoding one or more payload antibody polypeptides which targets a Clostridium difficile toxin, wherein said one or more payload antibody polypeptides comprise an antibody heavy chain, an antibody light chain, and a linker; wherein said antibody heavy chain comprises the polypeptide of SEQ ID NO: 3072; and wherein said antibody light chain comprises the polypeptide of SEQ ID NO: 3073.

2. The AAV particle of claim 1, wherein the viral genome is single stranded.

3. The AAV particle of claim 1, wherein the viral genome is self-complementary.

4. The AAV particle of claim 1, wherein the first nucleic acid segment is codon-optimized.

5. The AAV particle of claim 1, wherein the linker is selected from the group consisting of: SEQ ID NOs: 899-2947, CHP, FKK, HAA, ERK, ARL, DWY, GGS, IDQ, NKV, SEA, DWK, SAV, LSD, DAG, NSG, TSA, VPR, ONK, LGI, IDY, PGS, ATK, ASK, ANR, YDP, DEG, ECF, AIS, QRE, EHV, LME, TVQ, KQI, YKR, HRG, SNP, DIT, NSD, TDT, KLR, QAA, RHP, KNL, EIY, KRP, DIR, HKN, QAV, GGK, QGM, SGC, DTF, LCA, ALS, MDA, SII, FSP, RQF, ALS, AGV, ELE, DHK, AGY, EES, IPI, KEL, PDL, ITP, EVV, SAP, RQP, SDP, G, S, GG, GS, GGS, GGG, YDK, GSV, GWK, IAE, KRQ, QDT, TPN, DSS, YEQ, KNA, VGF, NKP, KFA, AEP, PTL, ASE, QDP, VKL, ASN, AIF, FFI, VTQ, SLV, KST, GAE, ISE, DKC, SAS, ATE, HNA, RET, VRP, EGK, PAT, THW, EIP, CAY, ISP, ADT, AVG, TLI, ILM, EGV, LEL, DGV, DLT, LGL, YGT, DGL, IDL, RLK, LNF, QSN, LKS, SGE, LFR, YGM, IAI, ITF, LID, ING, LLA, VPL, WGI, SKE, TLQ, PEI, NAR, RNP, FTK, VNK, DRN, AIQ, PLP, TNG, DKA, KFR, CAA, YVP, FNP, SAL, VRL, ERV, QYP, ITD, LTE, RHA, QFD, ETG, NIT, SLT, VRE, SRR, NDE, SSF, AKP, EYF, RFE, LMQ, ADG, RQP, IDP, VPV, VSN, RRI, LEA, QMH, TLR, VHP, TAK, KSY, LDG, LLE, and TYS.

6. The AAV particle of claim 1, wherein the first nucleic acid segment encodes from 5' to 3', the antibody heavy chain, the linker, and the antibody light chain.

7. The AAV particle of claim 1, wherein the first nucleic acid segment encodes from 5' to 3', the antibody light chain, the linker, and the antibody heavy chain.

8. A method of producing a functional antibody in a subject, comprising administering to said subject the AAV particle of claim 1.

9. A pharmaceutical composition comprising an AAV particle of claim 8 and a pharmaceutically acceptable excipient.

10. A method of treating Clostridium difficile infection in a subject, the method comprising administering to said subject the pharmaceutical composition of claim 9.

11. The AAV particle of claim 6, wherein the first nucleic acid segment encoding the linker (a) comprises an internal ribosome entry site (IRES), (b) encodes a T2A peptide, an F2A peptide, a furin cleavage site, or a glycine serine linker, or (c) is a combination of (a) and (b).

12. The AAV particle of claim 7, wherein the first nucleic acid segment encoding the linker (a) comprises an internal ribosome entry site (IRES), (b) encodes a T2A peptide, an F2A peptide, a furin cleavage site, or a glycine serine linker, or (c) is a combination of (a) and (b).

13. The AAV particle of claim 1, wherein the capsid comprises an AAV9 capsid protein, an AAV2 capsid protein, or a functional variant thereof.

14. The AAV particle of claim 1, wherein the viral genome further comprises a promoter operably linked to the payload region.

15. The AAV particle of claim 14, wherein the promoter comprises a tissue-specific promoter or a ubiquitous promoter.

16. The AAV particle of claim 14, wherein the promoter comprises an EF-1α promoter, a chicken β-actin (CBA) promoter and/or its derivative CAG, a cytomegalovirus (CMV) immediate-early enhancer and/or promoter, a β glucuronidase (GUSB) promoter, a ubiquitin C (UBC) promoter, a neuron-specific enolase (NSE), a platelet-derived growth factor (PDGF) promoter, a platelet-derived growth factor B-chain (PDGF-β) promoter, a synapsin (Syn) promoter, a methyl-CpG binding protein 2 (MeCP2) promoter, a Ca2+/calmodulin-dependent protein kinase II (CaMKII) promoter, a metabotropic glutamate receptor 2 (mGluR2) promoter, a neurofilament light (NFL) or heavy (NFH) promoter, a β-globin minigene nβ2 promoter, a preproenkephalin (PPE) promoter, an enkephalin (Enk) and excitatory amino acid transporter 2 (EAAT2), a glial fibrillary acidic protein (GFAP) promoter, a myelin basic protein (MBP) promoter or a functional variant thereof.

17. The AAV particle of claim 1, wherein the viral genome further comprises:
  (i) an enhancer;
  (ii) an intron;
  (iii) a Kozak sequence; and/or
  (iv) a polyadenylation sequence.

18. The AAV particle of claim 17, wherein the enhancer comprises a Cytomegalovirus Major Immediate-Early (CMVie) enhancer.

19. The AAV particle of claim 17, wherein the intron comprises a β-globin SD/immunoglobulin heavy chain splice acceptor (β-globin intron), or an SV40 late splice donor/splice acceptor (SV40 intron).

20. The AAV particle of claim 1, wherein the viral genome comprises a first ITR region positioned 5' relative to the payload region, and a second ITR region positioned 3' relative to the payload region.

\* \* \* \* \*